(12) United States Patent
Buerki et al.

(10) Patent No.: US 11,035,005 B2
(45) Date of Patent: Jun. 15, 2021

(54) CANCER DIAGNOSTICS USING BIOMARKERS

(71) Applicants: DECIPHER BIOSCIENCES, INC., San Diego, CA (US); MAYO FOUNDATION FOR MEDICAL EDUCATION AND RESEARCH, Rochester, MN (US)

(72) Inventors: Christine Buerki, Vancouver (CA); Anamaria Crisan, Vancouver (CA); Elai Davicioni, La Jolla, CA (US); Nicholas George Erho, Vancouver (CA); Mercedeh Ghadessi, New Westminster (CA); Robert B. Jenkins, Rochester, MN (US); Ismael A. Vergara Correa, West Vancouver (CA)

(73) Assignees: Decipher Biosciences, Inc., San Diego, CA (US); Mayo Foundation for Medical Education and Research, Rochester, MN (US)

( * ) Notice: Subject to any disclaimer, the term of this patent is extended or adjusted under 35 U.S.C. 154(b) by 341 days.

(21) Appl. No.: 13/968,838

(22) Filed: Aug. 16, 2013

(65) Prior Publication Data
US 2014/0066323 A1 Mar. 6, 2014

Related U.S. Application Data

(60) Provisional application No. 61/684,066, filed on Aug. 16, 2012, provisional application No. 61/764,365, (Continued)

(51) Int. Cl.
*C12Q 1/6886* (2018.01)

(52) U.S. Cl.
CPC ...... *C12Q 1/6886* (2013.01); *C12Q 2600/118* (2013.01); *C12Q 2600/158* (2013.01)

(58) Field of Classification Search
CPC ............... C12Q 1/6886; C12Q 1/6883; C12Q 2600/106; C12Q 2600/112;
(Continued)

(56) References Cited

U.S. PATENT DOCUMENTS 3,645,691 A 2/1972 Guenter et al.
3,687,808 A 8/1972 Thomas, Jr. et al.
(Continued)

FOREIGN PATENT DOCUMENTS

EP 0 684 315 11/1995
EP 1 409 727 11/2005
(Continued)

OTHER PUBLICATIONS

US 5,962,233 A, 10/1999, Livak et al. (withdrawn)
(Continued)

*Primary Examiner* — Diana B Johannsen
(74) *Attorney, Agent, or Firm* — Knobbe, Martens, Olson & Bear, LLP

(57) ABSTRACT

Disclosed herein, in certain instances, are methods, systems and kits for the diagnosis, prognosis and determination of cancer progression of a cancer in a subject. Further disclosed herein, in certain instances, are methods, systems and kits for determining the treatment modality of a cancer in a subject. The methods, systems and kits comprise expression-based analysis of biomarkers. Further disclosed herein, in certain instances, are probe sets for use in assessing a cancer status in a subject.

14 Claims, 67 Drawing Sheets

Specification includes a Sequence Listing.

Related U.S. Application Data filed on Feb. 13, 2013, provisional application No. 61/783,124, filed on Mar. 14, 2013.

(58) Field of Classification Search
CPC ........ C12Q 2600/118; C12Q 2600/156; C12Q 2600/158
See application file for complete search history.

(56) References Cited

U.S. PATENT DOCUMENTS

| | | | |
|---|---|---|---|
| 4,323,546 A | 4/1982 | Crockfor et al. |
| 4,683,195 A | 7/1987 | Mullis et al. |
| 4,683,202 A | 7/1987 | Mullis et al. |
| 4,800,159 A | 1/1989 | Mullis et al. |
| 4,965,188 A | 10/1990 | Mullis et al. |
| 5,130,238 A | 7/1992 | Malek et al. |
| 5,143,854 A | 9/1992 | Pinung et al. |
| 5,225,326 A | 7/1993 | Bresser et al. |
| 5,270,184 A | 12/1993 | Walker et al. |
| 5,283,174 A | 2/1994 | Arnold et al. |
| 5,288,514 A | 2/1994 | Ellman |
| 5,384,261 A | 1/1995 | Winkle et al. |
| 5,399,491 A | 3/1995 | Kacian et al. |
| 5,455,166 A | 10/1995 | Walker |
| 5,480,784 A | 1/1996 | Kacian et al. |
| 5,494,810 A | 2/1996 | Barany et al. |
| 5,538,848 A | 7/1996 | Livak et al. |
| 5,545,524 A | 8/1996 | Trent et al. |
| 5,677,195 A | 10/1997 | Winkler et al. |
| 5,705,365 A | 1/1998 | Ryder et al. |
| 5,710,029 A | 1/1998 | Ryder et al. |
| 5,711,029 A | 1/1998 | Ryder et al. |
| 5,744,305 A | 4/1998 | Fodor et al. |
| 5,814,447 A | 9/1998 | Ishiguro et al. |
| 5,824,518 A | 10/1998 | Kacian et al. |
| 5,830,711 A | 11/1998 | Barany et al. |
| 5,846,717 A | 12/1998 | Brow et al. |
| 5,854,033 A | 12/1998 | Lizardi |
| 5,854,206 A | 12/1998 | Twardzik et al. |
| 5,888,779 A | 3/1999 | Kacian et al. |
| 5,925,517 A | 7/1999 | Tyagi et al. |
| 5,928,862 A | 7/1999 | Morrison |
| 5,965,360 A | 10/1999 | Zain et al. |
| 5,985,557 A | 11/1999 | Prudent et al. |
| 5,989,815 A | 11/1999 | Skolnick et al. |
| 5,994,069 A | 11/1999 | Hall et al. |
| 6,001,567 A | 12/1999 | Brow et al. |
| 6,022,692 A | 2/2000 | Coulie et al. |
| 6,027,887 A | 2/2000 | Zavada et al. |
| 6,034,218 A | 3/2000 | Reed et al. |
| 6,090,543 A | 7/2000 | Prudent et al. |
| 6,121,489 A | 9/2000 | Dorner et al. |
| 6,136,182 A | 10/2000 | Dolan et al. |
| 6,150,097 A | 11/2000 | Tyagi et al. |
| 6,198,107 B1 | 3/2001 | Seville |
| 6,218,523 B1 | 4/2001 | French |
| 6,225,051 B1 | 5/2001 | Sugiyama et al. |
| 6,251,639 B1 | 6/2001 | Kurn |
| 6,262,245 B1 | 7/2001 | Xu et al. |
| 6,268,142 B1 | 7/2001 | Duff et al. |
| 6,303,305 B1 | 10/2001 | Wittwer et al. |
| 6,410,278 B1 | 6/2002 | Notomi et al. |
| 6,436,642 B1 | 8/2002 | Gould-Rothberg et al. |
| 6,541,205 B1 | 4/2003 | Yokoyama et al. |
| 6,573,043 B1 | 6/2003 | Cohen et al. |
| 6,630,358 B1 | 10/2003 | Wagner et al. |
| 6,723,506 B2 | 4/2004 | Fletcher et al. |
| 6,828,429 B1 | 12/2004 | Srivastava et al. |
| 7,008,765 B1 | 3/2006 | Bussemakers et al. |
| 7,186,514 B2 | 3/2007 | Zavada et al. |
| 7,211,390 B2 | 5/2007 | Rothberg et al. |
| 7,244,559 B2 | 7/2007 | Rothberg et al. |
| 7,264,929 B2 | 9/2007 | Rothberg et al. |
| 7,280,922 B2 | 10/2007 | Mei et al. |
| 7,300,788 B2 | 11/2007 | Matsuzaki et al. |
| 7,319,011 B2 | 1/2008 | Riggins et al. |
| 7,323,305 B2 | 1/2008 | Leamon et al. |
| 7,335,762 B2 | 2/2008 | Rothberg et al. |
| 7,358,061 B2 | 4/2008 | Yamamoto et al. |
| 7,361,488 B2 | 4/2008 | Fan et al. |
| 7,378,233 B2 | 5/2008 | Sidransky et al. |
| 7,407,755 B2 | 8/2008 | Lubinski et al. |
| 7,541,169 B2 | 6/2009 | Freimuth et al. |
| 7,598,052 B2 | 10/2009 | Giordanos et al. |
| 7,662,553 B2 | 2/2010 | Lenz et al. |
| 7,767,391 B2 | 8/2010 | Scott et al. |
| 7,901,881 B2 | 3/2011 | Libutti et al. |
| 7,901,888 B2 | 3/2011 | Kebebew |
| 7,914,988 B1 | 3/2011 | Chudin et al. |
| 7,927,826 B2 | 4/2011 | Riggins et al. |
| 8,008,009 B2 | 8/2011 | Choquet-Kastylevsky et al. |
| 8,202,692 B2 | 6/2012 | Giordano et al. |
| 8,273,539 B2 | 9/2012 | Klee et al. |
| 8,293,880 B2 | 10/2012 | Cote et al. |
| 8,299,233 B2 | 10/2012 | Andre et al. |
| 8,338,109 B2 | 12/2012 | Vasmatzis et al. |
| 8,354,228 B2 | 1/2013 | Ron |
| 8,465,914 B2 | 6/2013 | Brown et al. |
| 8,541,170 B2 | 9/2013 | Kennedy et al. |
| 8,568,971 B2 | 10/2013 | Brown et al. |
| 8,669,057 B2 | 3/2014 | Kennedy et al. |
| 8,802,599 B2 | 8/2014 | Aharonov et al. |
| 8,828,656 B2 | 9/2014 | Bullerdiek et al. |
| 8,877,445 B2 | 11/2014 | Shackney |
| 8,945,829 B2 | 2/2015 | Keutgen et al. |
| 9,040,286 B2 | 5/2015 | Zon et al. |
| 9,074,258 B2 | 7/2015 | Davicion et al. |
| 9,096,906 B2 | 8/2015 | Aharonov et al. |
| 9,157,123 B2 | 10/2015 | Xing |
| 9,175,352 B2 | 11/2015 | Keutgen et al. |
| 9,206,481 B2 | 12/2015 | Srivastava et al. |
| 9,206,482 B2 | 12/2015 | Davicloni et al. |
| 9,234,244 B2 | 1/2016 | Zeiger et al. |
| 9,435,812 B2 | 9/2016 | Pestano et al. |
| 9,495,515 B1 | 11/2016 | Giulia et al. |
| 9,534,249 B2 | 1/2017 | Vasmatzis et al. |
| 9,587,279 B2 | 3/2017 | Fahey, III et al. |
| 9,617,604 B2 | 4/2017 | Davicion et al. |
| 9,708,667 B2 | 7/2017 | Yanai et al. |
| 9,714,452 B2 | 7/2017 | Davicioni et al. |
| 9,856,537 B2 | 1/2018 | Kennedy et al. |
| 9,994,907 B2 | 6/2018 | Davicioni et al. |
| 10,114,924 B2 | 10/2018 | Kennedy et al. |
| 10,407,731 B2 | 9/2019 | Klee et al. |
| 10,422,009 B2 | 9/2019 | Davicioni et al. |
| 10,494,677 B2 | 12/2019 | Vasmatzis et al. |
| 2001/0051344 A1 | 12/2001 | Shalon et al. |
| 2002/0076735 A1 | 6/2002 | Williams et al. |
| 2002/0090633 A1 | 7/2002 | Becker et al. |
| 2002/0119463 A1 | 8/2002 | Fads |
| 2002/0168638 A1 | 11/2002 | Schlegel et al. |
| 2002/0169137 A1 | 11/2002 | Reiner et al. |
| 2002/0182586 A1 | 12/2002 | Morris et al. |
| 2003/0119168 A1 | 6/2003 | Madison et al. |
| 2003/0152980 A1 | 8/2003 | Golub et al. |
| 2003/0175736 A1 | 9/2003 | Chinnaiyan et al. |
| 2003/0185830 A1 | 10/2003 | Xu et al. |
| 2003/0186248 A1 | 10/2003 | Erlander et al. |
| 2003/0190602 A1 | 10/2003 | Pressman et al. |
| 2003/0194734 A1 | 10/2003 | Jatkoe |
| 2003/0224399 A1 | 12/2003 | Reed et al. |
| 2003/0235820 A1 | 12/2003 | Mack et al. |
| 2004/0009481 A1 | 1/2004 | Schlegel et al. |
| 2004/0019466 A1 | 1/2004 | Minor et al. |
| 2004/0029114 A1 | 2/2004 | Mack et al. |
| 2004/0058378 A1 | 3/2004 | Kong et al. |
| 2004/0259086 A1 | 12/2004 | Schlegel et al. |
| 2005/0042222 A1 | 2/2005 | Yamamoto et al. |
| 2005/0042638 A1 | 2/2005 | Arnold et al. |
| 2005/0048533 A1 | 3/2005 | Sidransky et al. |
| 2005/0064455 A1 | 3/2005 | Baker et al. |
| 2005/0118625 A1 | 6/2005 | Mounts |
| 2005/0137805 A1 | 6/2005 | Lewin et al. |
| 2005/0202442 A1 | 9/2005 | Morris et al. |

(56) References Cited

U.S. PATENT DOCUMENTS

| | | |
|---|---|---|
| 2005/0227917 A1 | 10/2005 | Williams et al. |
| 2005/0240357 A1 | 10/2005 | Minor |
| 2005/0250125 A1 | 11/2005 | Novakoff |
| 2005/0260646 A1 | 11/2005 | Baker et al. |
| 2005/0266443 A1 | 12/2005 | Croce et al. |
| 2005/0266459 A1 | 12/2005 | Poulsen |
| 2006/0019256 A1 | 1/2006 | Clarke et al. |
| 2006/0019615 A1 | 1/2006 | Ditmer |
| 2006/0035244 A1 | 2/2006 | Riggins et al. |
| 2006/0046253 A1 | 3/2006 | Nakao |
| 2006/0046265 A1 | 3/2006 | Becker et al. |
| 2006/0083744 A1 | 4/2006 | Chen et al. |
| 2006/0088851 A1 | 4/2006 | Erlander et al. |
| 2006/0094061 A1 | 5/2006 | Brys et al. |
| 2006/0105360 A1 | 5/2006 | Croce et al. |
| 2006/0127907 A1 | 6/2006 | Matsubara et al. |
| 2006/0134663 A1 | 6/2006 | Harkin et al. |
| 2006/0204989 A1 | 9/2006 | Kopreski |
| 2006/0211017 A1 | 9/2006 | Chinnaiyan et al. |
| 2007/0010469 A1 | 1/2007 | Chan |
| 2007/0020657 A1 | 1/2007 | Grebe et al. |
| 2007/0031873 A1 | 2/2007 | Wang et al. |
| 2007/0037165 A1 | 2/2007 | Venter et al. |
| 2007/0048738 A1 | 3/2007 | Donkena et al. |
| 2007/0065827 A1 | 3/2007 | Pauloski et al. |
| 2007/0065833 A1 | 3/2007 | Gupta |
| 2007/0083334 A1 | 4/2007 | Mintz et al. |
| 2007/0099197 A1 | 5/2007 | Afar et al. |
| 2007/0099209 A1 | 5/2007 | Clarke et al. |
| 2007/0105133 A1 | 5/2007 | Clarke et al. |
| 2007/0148667 A1 | 6/2007 | Williams et al. |
| 2007/0148687 A1 | 6/2007 | Bedingham et al. |
| 2007/0161004 A1 | 7/2007 | Brown et al. |
| 2007/0172841 A1 | 7/2007 | Wang |
| 2007/0172844 A1 | 7/2007 | Lancaster et al. |
| 2007/0212702 A1 | 9/2007 | Tomlins et al. |
| 2007/0220621 A1 | 9/2007 | Clarke et al. |
| 2007/0238119 A1 | 10/2007 | Yu et al. |
| 2007/0259352 A1 | 11/2007 | Bentwich et al. |
| 2007/0275915 A1 | 11/2007 | Hallenbeck et al. |
| 2008/0009001 A1 | 1/2008 | Bettuzzi et al. |
| 2008/0028302 A1 | 1/2008 | Meschkat |
| 2008/0044824 A1 | 2/2008 | Giordano et al. |
| 2008/0076674 A1 | 3/2008 | Litman et al. |
| 2008/0124344 A1 | 5/2008 | Combs et al. |
| 2008/0131892 A1 | 6/2008 | Becker et al. |
| 2008/0145841 A1 | 6/2008 | Libutti et al. |
| 2008/0254470 A1 | 10/2008 | Berlkin |
| 2008/0269157 A1 | 10/2008 | Srivastava et al. |
| 2008/0274457 A1 | 11/2008 | Eng et al. |
| 2008/0281568 A1 | 11/2008 | Kao et al. |
| 2009/0020433 A1 | 1/2009 | Cohen et al. |
| 2009/0036415 A1 | 2/2009 | Rubin et al. |
| 2009/0062144 A1 | 3/2009 | Guo |
| 2009/0075921 A1 | 3/2009 | Ikegawa |
| 2009/0149333 A1 | 6/2009 | Knudsen et al. |
| 2009/0191535 A1 | 7/2009 | Connelly et al. |
| 2009/0204333 A1 | 8/2009 | Friend et al. |
| 2009/0239221 A1 | 9/2009 | Chinnaiyan et al. |
| 2009/0280490 A1 | 11/2009 | Baker et al. |
| 2009/0298082 A1* | 12/2009 | Klee ............... C12Q 1/6886 435/6.16 |
| 2010/0055704 A1 | 3/2010 | Giordano et al. |
| 2010/0075384 A1 | 3/2010 | Kong et al. |
| 2010/0099093 A1 | 4/2010 | Weaver et al. |
| 2010/0130377 A1 | 5/2010 | Vasmatzis et al. |
| 2010/0131286 A1 | 5/2010 | Houlgatte et al. |
| 2010/0131432 A1 | 5/2010 | Kennedy et al. |
| 2010/0178653 A1 | 7/2010 | Aharonov et al. |
| 2010/0021538 A1 | 8/2010 | Iljin et al. |
| 2010/0215638 A1 | 8/2010 | Ijin et al. |
| 2010/0257617 A1 | 10/2010 | Ami et al. |
| 2010/0279327 A1 | 11/2010 | Ossovskaya |
| 2010/0285979 A1 | 11/2010 | Zeiger et al. |
| 2011/0009286 A1 | 1/2011 | Andre et al. |
| 2011/0045462 A1 | 2/2011 | Fu et al. |
| 2011/0092375 A1 | 4/2011 | Zamore et al. |
| 2011/0136683 A1 | 6/2011 | Davicioni |
| 2011/0152110 A1 | 6/2011 | Vierlinger et al. |
| 2011/0178163 A1 | 7/2011 | Chowdhury |
| 2011/0212855 A1 | 9/2011 | Rafnar et al. |
| 2011/0229894 A1 | 9/2011 | Levy et al. |
| 2011/0230372 A1 | 9/2011 | Willman et al. |
| 2011/0236903 A1 | 9/2011 | McClelland |
| 2011/0287946 A1 | 11/2011 | Gudmundsson et al. |
| 2011/0294123 A1 | 12/2011 | Nakamura et al. |
| 2011/0312520 A1 | 12/2011 | Kennedy et al. |
| 2012/0015839 A1 | 1/2012 | Chinnaiyan |
| 2012/0015843 A1 | 1/2012 | Von et al. |
| 2012/0041274 A1 | 2/2012 | Stone et al. |
| 2012/0108453 A1 | 5/2012 | Smit et al. |
| 2012/0115743 A1 | 5/2012 | Davicioni et al. |
| 2012/0122698 A1 | 5/2012 | Stacey et al. |
| 2012/0122718 A1 | 5/2012 | Reisman |
| 2012/0157334 A1 | 6/2012 | Beaudenon-Huibregtse et al. |
| 2012/0172243 A1 | 7/2012 | Davicioni et al. |
| 2012/0214165 A1 | 8/2012 | Walfish et al. |
| 2012/0220474 A1 | 8/2012 | Kennedy et al. |
| 2012/0304318 A1 | 11/2012 | Ohnuma et al. |
| 2013/0004974 A1 | 1/2013 | Klee et al. |
| 2013/0023434 A1 | 1/2013 | Van Laar |
| 2013/0142728 A1 | 6/2013 | Beaudenon-Huibregtse et al. |
| 2013/0150257 A1 | 6/2013 | Abdueva et al. |
| 2013/0172203 A1 | 7/2013 | Yeatman et al. |
| 2013/0184999 A1 | 7/2013 | Ding |
| 2013/0196866 A1 | 8/2013 | Pestano et al. |
| 2013/0225662 A1 | 8/2013 | Kennedy et al. |
| 2013/0231258 A1 | 9/2013 | Wilde et al. |
| 2013/0273543 A1 | 10/2013 | Gudmundsson et al. |
| 2013/0302808 A1 | 11/2013 | Vasmatzis |
| 2013/0302810 A1 | 11/2013 | Latham et al. |
| 2013/0303826 A1 | 11/2013 | Jurisica et al. |
| 2014/0030714 A1 | 1/2014 | Paschke et al. |
| 2014/0080731 A1 | 3/2014 | Davicioni et al. |
| 2014/0087961 A1 | 3/2014 | Sulem et al. |
| 2014/0099261 A1 | 4/2014 | Keutgen et al. |
| 2014/0121126 A1 | 5/2014 | Bivona et al. |
| 2014/0143188 A1 | 5/2014 | Mackey et al. |
| 2014/0228237 A1 | 8/2014 | Kennedy et al. |
| 2014/0243240 A1 | 8/2014 | Soldin et al. |
| 2014/0302042 A1 | 10/2014 | Chin et al. |
| 2014/0315199 A1 | 10/2014 | Rhodes et al. |
| 2014/0315739 A1 | 10/2014 | Aharonov et al. |
| 2014/0349856 A1 | 11/2014 | Schnabel et al. |
| 2014/0349864 A1 | 11/2014 | Kennedy et al. |
| 2014/0371096 A1 | 12/2014 | Umbright et al. |
| 2015/0011401 A1 | 1/2015 | Davicioni et al. |
| 2015/0038376 A1 | 2/2015 | Tian et al. |
| 2015/0099665 A1 | 4/2015 | Rosenfeld et al. |
| 2015/0141470 A1 | 5/2015 | Garraway et al. |
| 2015/0275306 A1 | 10/2015 | Bernards et al. |
| 2015/0292030 A1 | 10/2015 | McConkey |
| 2015/0299808 A1 | 10/2015 | Gonzalez et al. |
| 2015/0307947 A1 | 10/2015 | Basu et al. |
| 2015/0329915 A1 | 11/2015 | Davicioni et al. |
| 2015/0368724 A1 | 12/2015 | Aharonov et al. |
| 2016/0024586 A1 | 1/2016 | Delfour et al. |
| 2016/0032395 A1 | 2/2016 | Davicioni et al. |
| 2016/0032400 A1 | 2/2016 | Gomis et al. |
| 2016/0068915 A1 | 3/2016 | Kennedy et al. |
| 2016/0076108 A1 | 3/2016 | Davicioni et al. |
| 2016/0115546 A1 | 4/2016 | Rosenfeld et al. |
| 2016/0120832 A1 | 5/2016 | Rabinowitz et al. |
| 2016/0251729 A1 | 9/2016 | Chinnaiyan et al. |
| 2016/0312305 A1 | 10/2016 | Kennedy et al. |
| 2016/0312306 A1 | 10/2016 | Kennedy et al. |
| 2016/0312307 A1 | 10/2016 | Kennedy et al. |
| 2016/0312308 A1 | 10/2016 | Kennedy et al. |
| 2016/0348184 A1 | 12/2016 | Chinnaiyan |
| 2017/0016076 A1 | 1/2017 | Barnett-Itzhaki et al. |
| 2017/0145513 A1 | 5/2017 | Kennedy et al. |
| 2017/0166980 A1 | 6/2017 | Fahey, III et al. |
| 2017/0329894 A1 | 11/2017 | Kennedy et al. |
| 2018/0016642 A1 | 1/2018 | Kennedy et al. |

(56) References Cited

U.S. PATENT DOCUMENTS

| | | |
|---|---|---|
| 2018/0216197 A1 | 1/2018 | Davicioni et al. |
| 2018/0030540 A1 | 2/2018 | Davicioni et al. |
| 2018/0068058 A1 | 3/2018 | Abdueva et al. |
| 2018/0112275 A1 | 4/2018 | Davicioni et al. |
| 2018/0122508 A1 | 5/2018 | Wilde et al. |
| 2018/0127832 A1 | 5/2018 | Kennedy et al. |
| 2018/0291459 A1 | 10/2018 | Al-Deen Ashab et al. |
| 2019/0017123 A1 | 1/2019 | Davicioni et al. |
| 2019/0191133 A1 | 6/2019 | Ostrow |
| 2019/0204322 A1 | 7/2019 | Alshalalfa et al. |
| 2019/0218621 A1 | 7/2019 | Davicioni |
| 2020/0165682 A1 | 5/2020 | Chinnaiyan et al. |
| 2020/0224276 A1 | 7/2020 | Chinnaiyan et al. |

FOREIGN PATENT DOCUMENTS

| | | |
|---|---|---|
| EP | 2 366 800 A1 | 9/2011 |
| WO | WO 1990/015070 A1 | 12/1990 |
| WO | WO 1992/010092 A1 | 6/1992 |
| WO | WO 1993/009668 A1 | 5/1993 |
| WO | WO 1993/022684 A1 | 11/1993 |
| WO | WO 1998/045420 A1 | 10/1998 |
| WO | WO 2001/060860 A2 | 8/2001 |
| WO | WO 2001/066753 A1 | 9/2001 |
| WO | WO 2002/000929 A1 | 1/2002 |
| WO | WO 2003/012067 A2 | 2/2003 |
| WO | WO 2004/037972 A2 | 5/2004 |
| WO | WO 2005/040396 A2 | 5/2005 |
| WO | WO 2005/085471 A2 | 9/2005 |
| WO | WO 2005/100608 A2 | 10/2005 |
| WO | WO 2006/047484 A2 | 5/2006 |
| WO | WO 2006/091776 A2 | 8/2006 |
| WO | WO 2006/110264 A2 | 10/2006 |
| WO | WO 2006/127537 A2 | 11/2006 |
| WO | WO 2006/135596 A2 | 12/2006 |
| WO | WO 2007/056049 A2 | 5/2007 |
| WO | WO 2007/070621 A2 | 6/2007 |
| WO | WO 07/081740 | 7/2007 |
| WO | WO 2007/081720 A2 | 7/2007 |
| WO | WO 2008/023087 A2 | 2/2008 |
| WO | WO 2008/046911 A2 | 4/2008 |
| WO | WO 2008/086478 A2 | 7/2008 |
| WO | WO 2008/112283 A2 | 9/2008 |
| WO | WO 2009/009432 A2 | 1/2009 |
| WO | WO 2009/020521 A2 | 2/2009 |
| WO | WO 2009/020905 A2 | 2/2009 |
| WO | WO 09/029266 | 3/2009 |
| WO | WO 2009/045115 A1 | 4/2009 |
| WO | WO 09/074968 | 6/2009 |
| WO | WO 2009/074968 A2 | 6/2009 |
| WO | WO 2009/143603 A1 | 12/2009 |
| WO | WO 10/018601 | 2/2010 |
| WO | WO 2010/056374 A2 | 5/2010 |
| WO | WO 10/073248 | 7/2010 |
| WO | WO 2010/056374 A3 | 9/2010 |
| WO | WO 2010/099598 A1 | 9/2010 |
| WO | WO 10/123626 | 10/2010 |
| WO | WO 2010/124372 A1 | 11/2010 |
| WO | WO 2011/150453 A1 | 12/2011 |
| WO | WO 2012/031008 A2 | 3/2012 |
| WO | WO 2012/068383 A2 | 5/2012 |
| WO | WO 2012/135008 A1 | 10/2012 |
| WO | WO 13/006495 | 1/2013 |
| WO | WO 2013/088457 A1 | 6/2013 |
| WO | WO 2013/090620 A1 | 6/2013 |
| WO | WO 2013/116742 A1 | 8/2013 |
| WO | WO 2014/028884 A2 | 2/2014 |
| WO | WO 2014/043803 A1 | 3/2014 |
| WO | WO 14/085666 | 5/2014 |
| WO | WO 14/151764 | 9/2014 |
| WO | WO 15/073949 | 5/2015 |
| WO | WO 2015/071876 A2 | 5/2015 |
| WO | WO 16/141127 | 9/2016 |
| WO | WO 17/062505 | 4/2017 |
| WO | WO 2017/0059549 A1 | 4/2017 |
| WO | WO 2017/062505 A1 | 4/2017 |
| WO | WO 2018/165600 A1 | 9/2018 |
| WO | WO 19/023517 | 1/2019 |

OTHER PUBLICATIONS

Cuzick, J. et al. Lancet Oncology 12:245 (Feb. 2011).*
Bibikova, M. et al. Genomics 89:666 (2007).*
Penney, K.L. et al. Journal of Clinical Oncology 29:2391 (Jun. 2011).*
Penney, K.L. et al. Appendix (9 pages) of Journal of Clinical Oncology 29:2391 (Jun. 2011).*
Wang, Z. et al. Nature Reviews 10:57 (Jan. 2009).*
Chen, J.L. et al. Clinical Cancer Research 18(16):4291 (Jun. 2012).*
Kiessling, A. et al. The Prostate 64:387 (2005).*
Zelefsky, M.J. et al. The Journal of Urology 166:876 (Sep. 2001).*
Romanuik, T.L. et al. BMC Medical Genomics 3:43 (2010).*
International Search Report regarding PCT/US2013055429, (dated Mar. 3, 2014).
Extended European Search Report dated Apr. 4, 2016, regarding EP 13 82 9137.
Abdueva et al., "Quantitative Expression Profiting in Formalin-Fixed ParaffinEmbedded Samples by Affymetrix Microarrays," Journal of Molecular Diagnostics, vol. 12, No. 4, Jul. 2010, pp. 409-417.
Agell et al., "A 12-Gene Expression Signature Is Associated with Aggressive Histological in Prostate Cancer: SEC14L1 and TCEB1 Genes Are Potential Markers of Progression," Am J Pathol, 2012, vol. 181 (5), pp. 1585-1594.
Aldred et al., "Papillary and follicular thyroid carcinomas show distinctly different microarray expression profiles and can be distinguished by a minimum of five genes," J Clin Oncol. 2004;22(17):3531-9.
Amundson et al., "Integrating global gene expression and radiation survival parameters across the 60 cell lines of the National Cancer Institute Anticancer Drug Screen," Cancer Research, 2008, 68(2):415-424.
Ausubel, et al. Current Protocols in Molecular Biology. Wiley & Sons, New York, 1995, Table of Contents.
Baetke et al., "Molecular Pathways Involved in Prostate Carcinogenesis: Insights from Public Microarray Datasets," PLoS ONE (2012), 7(11):e49831, 1-11.
Ballman et al,, "Faster cyclic loess: normalizing RNA arrays via linear models," Bioinformatics, 2004, 20 :2778-2786.
Bannert et al., "Retroelements and the human genome: new perspectives on an old relation." Proc Natl Acad Sci U SI\. Oct. 5, 2004; 101 Suppl 2:14572-9.
Barlow et al., "Analysis of Case-Cohort Designs," J Clin Epidemiol, 1999, vol. 52 (12), 1165-1172.
Bauer et al., "Identification of Markers of Taxane Sensitivity Using Proteomic and Genomic Analyses of Breast Tumor from Patients Receiving Neoadjuvant Paclitaxel and Radiation," Clin. Cancer Res. (2010), 16(2):681-690, American Association for Cancer Research.
Bergstralh et al., "Software for optimal matching in observation al studies," Epidemiology, 1996, 7(3):331-332.
Best et al., "Molecular differentiation of high- and moderate-grade human prostate cancer by cDNA microarray analysis", Diagn Mol Pathol., 2003, 12(2):63-70.
Bibikova et al., "Quantitative gene expression profiling in formalin-fixed, paraffin-embedded tissues using universal bead arrays," Am J Pathol., 2004, 165:1799-1807.
Bibikova et al., "Gene expression profiles in formalin-fixed, paraffin-embedded tissues obtained with a novel assay for microarray analysis," Clin Chem., 2004, 50:2384-2386.
Birney et al., "Identification and analysis of functional elements in 1% of the human genome by the ENCODE pilot project." Nature. Jun. 14, 2007; 447(7146):799-816.
Boorjian et al., "Long-term risk of clinical progression after biochemical recurrence following radical prostatectomy: the mpact of time from surgery to recurrence." Eur Urol. Jun. 2011; 59(6):893-9.
Boormans et al., "Identification of TDRD1 as a direct target gene of ERG in primary prostate cancer," Int J Cancer, (2013) vol. 133 (2), pp. 335-345.

(56) References Cited

OTHER PUBLICATIONS

Bostwick et al., "Prognostic factors in prostate cancer: College of American Pathologists consensus statement," Arch Pathol Lab Med, 2000, 124(7):995-1000.
Bott et al., "Prostate cancer management: (2) an update on locally advanced and metastatic disease", Postgrad Med J, Dec. 3, 2003, 79(937), 643-645.
Breiman, "Random Forests," Machine Learning, 2001, 45:5-32,.
Brouha et al., "Hot L1s account for the bulk of retrotransposition in the human population." Proc Natl Acad Sci U S A. Apr. 29, 2003; 100(9):5280-5.
Bull et al., "Identification of potential diagnostic markers of prostate cancer and prostatic intraepithelial neoplasia using cDNA microarrav," British J Cancer, Jun. 1, 2001, 84(11):1512-1519.
Bussmakers et al., "DD3: a new prostate-specific gene, highly overexpressed in prostate cancer." Cancer Res. Dec. 1, 1999; 59(23):5975-9.
Cerutti et al. "Diagnosis of suspicious thyroid nodules using four protein blomarkers," Clin Cancer Res, 2006;12(11 Pt 1):3311-8.
Chalitchagorn et al., "Distinctive pattern of LINE-1 methylation level in normal tissues and the association with carcinogenesis." Oncogene, Nov. 18, 2004; 23(54):8841-6.
Che et al,: "Prognostic Value of Abnormal p53 Expression in Locally Advanced Prostate Cancer Treated With Androgen Deprivation and Radiotherapy: A Study Based on RTOG 9202"; International Journal of Radiation: Oncology Biology Physics, rvol. 69, No. 4, Nov. 15, 2007, pp. 1117-1123.
Chen et al., "Significance of noninvasive diagnosis of prostate cancer with cytologic examination of prostatic fluid," J Nippon Med Sch., 73(3):129-135, Jun. 2006.
Chen et al.: "Molecular determinants of resistance to antiandrogen therapy"; Nature Medicine, Nature Publishing Group, New York, NY, vol. 10, No. 1, Jan. 1, 2004, pp. 33-39.
Cheng et al. "Cell Proliferation in Prostate Cancer Patients with Lymph Node Metastasis", Clin Cancer Res, Oct. 1999, 5(10): 2820-2823.
Cheville et at., "Gene Panel Model Predictive of Outcome in Men at High-Risk of Systemic Progression and Death From Prostate Cancer After Radical Retropubic Prostatectomy,"; Journal of Clinical Oncology vol. 26 , No, 24, Aug. 20, 2008.
Chifman et al., "Conservation of immune gene signatures in solid tumors and prognostic implications," BMC Cancer (2016) 16:911, pp. 1-17. DOI 10.1186/S12885-016-2948-Z.
Chow et al., "LINE-1 activity in facultative heterochromatin formation during X chromosome inactivation." Cell. Jun. 11, 2010; 141(6):956-69.
Cibas, et al. "The Bethesda System for Reporting Thyroid Cytopathology," Am J Clin Pathol. Nov. 2009;132(5):658-65. doi: 10.1309/AJCPPHLWMI3JV4LA.
Clancy et al., "Profiling networks of distinct immune-cells in tumors," BMC Bioinformatics (2016) 17:263, pp. 1-15. DOI 10.1186/s12859-016-1141-3.
Clark-Langone et al. "Riornarker discovery for colon cancer using a 761 gene RT-PCR assay 2007," BMC Genomics 8:279 pp. 1-18 2007.
Cooperberg et al., "The CAPRA-S score: A straightforward tool for improved prediction of outcomes after radical prostatectomy," Cancer (2011) vol. 117 (22), pp. 5039-5046.
Cordaux et al., "The impact of retrotransposons on human genome evolution." Nat Rev Genet. Oct. 2009; 10 10):691-703.
Dalela et al., "Contemporary Role of the Decipher Test in Prostate Cancer Management: Current Practice and Future Perspectives," Rev. Urol. (2016), 18(1):1-9, MedReviews®, LLC.
Dalsgaard Sorensen et al.: "Discovery of prostate cancer biomarkers by microarray gene expression profiling"; Expert Review of Molecular Diagnostics, vol. 10, No. 1, Jan. 1, 2010, pp. 49-64.
D'Amico et al., "Cancer-specific mortality after surgery or radiation for patients with clinically localized prostate cancer managed during the prostate-specific antigen era," J Clin Oncol., 2003, 21:2163-2172.
Dawood, Shaheenah, "Novel Biomarkers of Metastatic Cancer," Expert Rev. Mo/. Diagn. (2010), 10(5):581-590, Expert Reviews Ltd.
Day et al., "Estimating enrichment of repetitive elements from high-throughput sequence data." Genome Biol. 2010; 11 6):R69.
Demichelis et al., "TMPRSS2:ERG gene fusion associated with lethal prostate cancer in a watchful waiting cohort," Oncogene, 2007, 26:4596-4599.
Dhanasekaran et al., "Delineation of prognostic biomarkers in prostate cancer," Nature, 2001, 412: 822-826.
Dougherty, "The fundamental role of pattern recognition for gene-expression/microarray data in bioinformatics," Pattern recognition. 2005; 38:2226-2228.
Eder et al., "Genes differentially expressed in prostate cancer," BJU Int., May 2004, 93(8): 1151-1155.
Edwards et al.: "MicroRNAs and Ultraconserved Genes as Diagnostic Markers and Therapeutic Targets in Cancer and Cardiovascular Diseases", Journal of Cardiovascular Translational Research, vol. 3, No. 3, May 5, 2010, pp. 271-279.
Englisch, et al., "Chemically Modified Oligonucleotides as Probes and Inhibitors," Angew. Chem. Int. Ed. Eng. 1991; 30:613-629.
Erho et al., "Discovery and Validation of a Prostate Cancer Genomic Classifier that Predicts Early Metastasis Following Radical Prostatectomy," PLoS ONE (2013), 8(6):e66855, 1-12.
Ernst et al., "Decrease and gain of gene expression are equally discriminatory markers for prostate carcinoma: a gene expression analysis on total and microdissected prostate tissue," Am J Pathol., Jun. 2002, 160(6):2169-2180.
Fan et al., "Concordance among gene-expression-based predictors for breast cancer," N Engl J Med., 2006, 355;560-569.
Finley et al., "Advancing the molecular diagnosis of thyroid nodules: defining benign lesions by molecular profiling," Thyroid (2005) 15(6):562-8.
Finley et al., "Discrimination of benign and malignant thyroid nodules by molecular profiling," Ann Surg. (2004) 240(3):425-36; discussion 436-7.
Fodor et al., "Light-directed, spatially addressable parallel chemical synthesis," Science, Feb. 15, 1991; 251(4995):767-73.
Foley et al., "Molecular pathology of prostate cancer: the key to identifying new blomarkers of disease," Endocrine-Related Cancer, 2004, 11:477-488.
Fontaine, et al., "Increasing the number of thyroid lesions classes in microarray analysis improves the relevance of diagnostic markers," PLoS One. Oct. 29, 2009; 4(10):e7632. doi: 10.1371/journal.pone.0007632.
Fujarewicz et al., "A multi-gene approach to differentiate papillary thyroid carcinoma from benign lesions: gene selection using support vector machines with bootstrapping," Endocr Relat Cancer (Sep. 2007) 14(3):809-26.
Gait. Chapter 16: Oligoribonucleotides. Antisense Research and Applications, Crookeand Lebleu Eds., CRC Press (pp. 289-302) (1993).
Gao et al., "VISTA is an inhibitory immune checkpoint that is increased after ipilimumab therapy in patients with prostate cancer," Nat Med. (May 2017) 23(5):551-555.
Gibb et al., "The functional role oflong non-coding RNA in human carcinomas", Molecular Cancer, Biomed Central, London, GB, vol. 10, No. 1, Apr. 13, 2011, p. 38.
Glinsky et al., "Gene expression profiling predicts clinical outcome of prostate cancer," J Clin Investigation (2004) 113(6):913-923.
Glinsky et al., "Microarray analysis identifies a death-from-cancer signature predicting therapy i failure in patients with multiple types of cancer," J Clin Invest. (2005) 115: 1503-1521.
Greenbaum et al.: "Comparing protein abundance and mRNA expression levels on a genomic scale"; Genome Biology, 2003, 4(9):117.1-117.8.
Griffith et al., "Meta-analysis and meta-review of thyroid cancer gene expression profiling studies identifies important diagnostic biomarkers," J Clin Oncol. (2006) 24(31):5043-51.
Griffith, et al. Biomarker panel diagnosis of thyroid cancer: a critical review. Expert Rev Anticancer Ther. Sep. 2008;8(9):1399-413. dol: 10.1586/14737140.8.9.1399.

(56) References Cited

OTHER PUBLICATIONS

Gupta et al., "Long non-coding RNA HOTAIR reprograms chromatin state to promote cancer metastasis," Nature (Apr. 15, 2010) 464(7291): 1071-6.
Guttman et al., "Chromatin signature reveals over a thousand highly conserved large non-coding RNAs in mammals", Nature Mar. 12, 2009; 458(7235):223-7.
Guttman et al., "Ab initio reconstruction of cell type-specific transcriptomes in mouse reveals the conserved multi- xonic structure of lincRNAs," Nat Biotechnol. May 2010; 28(5):503-10.
Haiman et al.: "Multiple regions within 8q24 independently affect risk for prostate cancer"; Nat Genet., 2007, 39:638-644.
Hamada et al., "Diagnostic usefulness of PCR profiling of the differentially expressed marker genes in thyroid papillary carcinomas," Cancer Lett. Jun. 28, 2005;224(2):289-301. Epub Nov. 18, 2004.
He et al., "The antisense transcriptomes of human cells", Science Dec. 19, 2008; 322(5909): 1855-7.
Heemers, H. V. et al.: "Identification of a Clinically Relevant Androgen-Dependent Gene Signature in Prostate Cancer"; Cancer Research, vol. 71, No. 5, 2011, pp. 1978-1988.
Heidenreich et al., "EAU Guidelines on Prostate Cancer. Part 1: Screening, Diagnosis, and Treatment of Clinically Localised Disease," European Urology, (2011) vol. 59, pp. 61-71.
Henshall et al., "Survival Analysis of Genome-Wide Gene Expression Profiles of Prostate ancers Identifies New Prognostic Targets of Disease Relapse," Cancer Research 63, 14196-4203, Jul. 15, 2003.
Holzbeierlein et al., "Gene expression analysis of human prostate carcinoma during hormonal therapy identifies androgen-responsive genes and mechanisms of therapy resistance," Am. J . Pathol., Jan. 2004, 164(1):217-227.
Hornberger et al., "A Multigene Prognostic Assay for Selection of Adjuvant Chemotherapy in Patients with T3, Stage II Colon Cancer: Impact on Quality-Adjusted Life Expectancy and Costs," Value in Health 15 (2012) pp. 1014-1021.
Huarte et al., "Large non-coding RNAs: missing links in cancer?" Human Molecular Genetics (Oct. 15, 2010) 19(2): R152-R161.
Hughes et al., "Molecular pathology of prostate cancer," J Clin Pathol., Jul. 2005, 58(7):673-684.
Hughes et al., "Topoisomerase II—a expression increases with increasing Gleason score and with hormone insensitivity in prostate carcinoma," J Clin Pathol,, 59(7): 721-724, Jul. 2006.
Jhavar et al., "Integration of ERG gene mapping and gene☐expression profiling identifies distinct categories of human prostate cancer," BJUI (2008) vol. 103 (9), pp. 1256-1269.
Kanehisa, "Use of statistical criteria for screening potential homologies in nucleic acid sequences," Nucleic Acids Res. Jan. 11, 1984;12(1 Pt 1):203-13.
Kasraeian, et al. , "A comparison of fine-needle aspiration, core biopsy, and surgical biopsy in the diagnosis of extremity soft tissue masses," Clin Orthop Relat Res. (Nov. 2010) 468(11):2992-3002.
Kebebew et al., "Diagnostic and extent of disease multigene assay for malignant thyroid neoplasms," Cancer (2006) 106(12):2592-7.
Khor et al.: "Bcl-2 and Bax Expression Predict Prostate Cancer Outcome in Men Treated with Androgen Deprivation and Radiotherapy on Radiation Therapy Oncology Group Protocol 92-02"; Clinical Cancer Research, vol. 13, No. 12, Jun. 15, 2007, pp. 3585-3590.
Kikuchi et al., "Expression profiles of non-small cell lung cancers on cDNA microarrays: identification of genes for prediction of lymph-node metastasis and sensitivity to anti-cancer drugs," Oncogene (2003) 22, pp. 2192-2205.
Kosari et al., "Identification of blomarkers for prostate cancer," Clin. Cancer Res., 2008, 1734-1743.
Koshkin et al., "LNA (locked nucleic acids): An RNA mimic forming exceedingly stable LNA," LNA duplexes. J Am Chem Soc 120:13252-13253 (1998).

Koshkin et al., "LNA (locked nucleic acids): synthesis of the adenine, cytosine, guanine 5-methylcytosine, thymine and uracil bicyclonucleoside monomers, oligomerisation, and unprecedented nucleic acid recognition," Tetrahedron (1998) 54(14):3607-3630.
Kroschwitz the Concise Encyclopedia of Polymer Science and Engineering. (pp. 858-859) (1990).
Kube et al., "Optimization of laser capture microdissection and RNA amplification for gene expression profiling of prostate cancer", BMC Mol. Biol., 2007, 8:25.
Kumar, et al., "The first analogues of LNA (locked nucleic acids): phosphorothioate-LNA and 2'-thio-LNA," Bioorg Med Chem Lett. (Aug. 18, 1998) 8(16):2219-22.
Landers et al,: "Use of multiple biomarkers for a molecular diagnosis of prostate cancer"; Int. J. Cancer, 114, May 10, 2005, pp. 950-956.
Lapointe et al., "Gene expression profiling identifies clinically relevant subtypes of prostate cancer," Proc Natl Acad Sci USA, 2004, 101:811-816.
Latulippe et al., "Comprehensive Gene Expression Analysis of Prostate Cancer Reveals Distinct Transcriptional Programs Associated with Metastatic Disease," Cancer Res., 2002, 62:4499-4506.
Lin et al., "Nuclear receptor-induced chromosomal proximity and DNA breaks underlie specific translocations in cancer", Cell. Dec. 11, 2009; 139(6):1069-83.
Lockstone, "Exon array data analysis using Affymetrix power tools and R statistical software," Briefings in bioinformatics (2011) vol. 12 (6), pp. 634-644.
Magee et al., "Expression Profiling Reveals Hepsin Overexpression in Prostate Cancer," Cancer Res., 2001, 61:5692-5696.
Martens-Uzunova, E. S. et al.: "Diagnostic and prognostic signatures from the small non-codin RNA transcriptome in prostate cancer", Oncogene, vol. 31, No. 8, Jul. 18, 2011, pp. 978-991.
Martin, "A New Access to 2'-O-Alkylated Ribonucleosides and Properties of 2'-O-Alkylated Oligoribonucleotides," Helv. Chin Acta. (1995) 78:486-504. (in German with English abstract).
Mazzanti, et al., "Using gene expression profiling to differentiate benign versus malignant thyroid tumors," Cancer Res, Apr. 15, 2004; 64(8):2898-903.
McCall et al., "Frozen robust multiarray analysis (fRMA)", Biostatistics, 2010, vol. 11 (2), 242-253.
Mineva et al., "Differential expression of alphaB-crystallin and Hsp27-1 in anaplastic thyroid carcinomas because of tumor-specific alphaB-crystallin gene (CRYAB) silencing," Cell Stress Chaperones (2005) Autumn;10(3):171-84.
Nakagawa et al., "A Tissue Blomarker Panel Predicting Systemic Progression after PSA Recurrence Post-Definitive Prostate Cancer. Therapy," PLos ONE, 2008, 3(5):e2318, 14 pages.
Newson, Roger, "Confidence intervals for rank statistics: Somers' D and extensions", Stata Journal, 6(3):309-334; Sep. 2006.
Nielsen et al., "Sequence-selective recognition of DNA by strand displacement with a thymine-substituted polyamide," (1991) Science. 254: 1497-1500.
Noordzij et al. "The prognostic value of CD44 isoforms in prostate cancer patients treated by radical prostatectomy", Clin Cancer Res, May 1997, 3(5): 805-815.
Norman, James, "Thyroid Nodule Ultrasound", Endocrine website, Updated Oct. 13, 2010, http://www.endocrineweb.com/noduleus.html.
Parker et al., "High expression levels of surviving protein independently predict a poor outcome for patients who undergo surgery for clear cell renal cell carcinoma," Cancer, 2006, 107:37-45.
Pascal et al., "Correlation of mRNA and protein levels: Cell type-specific gene expression of cluster designation antigens in the prostate," BMC Genomics, 2008, 9:246 (13 pages).
Patel et al., "Preoperative PSA velocity is an independent prognostic factor for relapse after radical prostatectomy," J Clin Oncol., 2005, 23:6157-6162.
Pereira et al, "Coagulation factor V and VIIN ratio as predictors of outcome in paracetamol induced fulminant hepatic failure: relation to other prognostic indicators," Gut, 1992, 33 :98-102.
Pienta et al. "The current state of preclinical prostate cancer animal models"; Prostate (2008) 69: 629-639.

(56) References Cited

OTHER PUBLICATIONS

Pilepich et al., "Phase III radiation therapy oncology group (RTOG) trial 86-10 of androgen deprivation adjuvant to definitive radiotherapy in locally advanced carcinoma of the prostate," Int. J. Radiation Oncology Biol. Phys. (2001) vol. 50, No. 5, pp. 1243-1252.
Pinover et al., "Validation of a treatment policy for patients with prostate specific antigen failure after three-dimensional conformal prostate radiation therapy," Cancer (Feb. 15, 2003) vol. 97, No. 4, pp. 1127-1133.
Pittoni et al., "The Dark Side of Mast Cell-Targeted Therapy in Prostate Cancer," Cancer Res. (2012) 72(4):831-835.
Porkka et al: Molecular mechanisms of prostate cancer; Eur Urol., 2004, 45(6):683-691.
Pound et al., "Natural history of progression after PSA elevation following radical prostatectomy," JAMA, 1999, 281:1591-1597.
Prasad et al., "Identification of genes differentially expressed in benign versus malignant thyroid tumors," Clin Cancer Res. (2008) 14(11):3327-37.
Prensner et al., "Transcriptome Sequencing Identifies PCAT-1, a Novel lincRNA Implicated in Prostate Cancer Progression," (2012) 29 (8): 742-749.
Puskas, et al., "Gene profiling identifies genes specific for well-differentiated epithelial thyroid tumors," Cell Mol Biol (Noisy-le-grand) (Sep. 5, 2005) 51(2):177-86.
Reis et al., "Antisense intronic non-coding RNA levels correlate to the degree of tumor differentiation in prostate cancer," Oncogene (2004) 23(39):6684-6692.
Rhodes et al., "Multiplex biomarker approach for determining risk of prostatespecific antigen-defined recurrence of prostate cancer," J Nat Cancer Inst. (May 7, 2003) vol. 95, No. 9, pp. 661-668.
Rhodes et al., "Large-scale meta-analysis of cancer microarray data identifies common transcriptional profiles of neoplastic transformation and progression," Proc Nat Acad Sci USA (2004) 101:9309-9314.
Rhodes et al., "ONCOMINE: A Cancer Microarray Database and Integrated Data-Mining Platform," Neoplasia (2004) 6:1-6.
Rinn et al., "Functional demarcation of active and silent chromatin domains in human HOX loci by noncoding RNAs," Cell (Jun. 29, 2007) 129(7):1311-23.
Robertson et al., "DNA in radical prostatectomy specimens. Prognostic value of tumor ploidy," Acta Oncologica (1991) 30(2):205-207.
Robinson, et al., "A comparison of Affymetrix gene expression arrays," BMC Bioinformatios, Nov. 15, 2007;8:449.
Robinson et al., "A dynamic programming approach for the alignment of signal peaks in multiple gas chromatography-mass spectrometry experiments," BMC Bioinformatics (2007) 8.1:419.
Rotblat et al., "A Possible Role for Long Non-Coding RNA in Modulating Signaling Pathways," Med, Hvnotheses (2011), 77:962-965, Elsevier.
Rubin et al., "Molecular genetics of human prostate cancer," Modern Pathol. (2004) 17(3):380-388.
Sanghvi, "Heterocyclic base modifications in nucleic acids and their applications in antisense oligonucleotides in Antisense Research and Applications," Crooke, S. T. and Lebleu, B., ed., CRC Press. 1993; Ch 15 274-285.
Saramaki et al., "Amplification of EIF3S3 gene is associated with advanced stage in prostate cancer," Am J Pathol. (2001) 159:2089-2094.
Sato et al., "Clinical significance of alterations of chromosome 8 in high-grade, advanced, nonmetastatic prostate carcinoma," J Natl Cancer Inst., 1999, 91:1574-1580.
Savinainen et al., "Expression and copy No. analysis of TRPS 1, EIF3S3 and MYC genes in breast and prostate cancer," Br J Cancer, 2004, 90: 1041-1046.
Schumacher et al., "A Common 8q24 Variant in Prostate and Breast Cancer from a Large Nested Case-Control Study," Cancer Res. (2007) 67:2951-2956.
Severi et al., "The Common Variant rs1447295 on Chromosome 8q24 and Prostate Cancer Risk: Results from an Australian Population-based Case-Control Study", Cancer Epidemiology, Biomarkers & Prevention (2007) 16:610-611.
Shariat et al., "Survivin expression is associated with features of biologically aggressive prostate carcinoma," Cancer, 2004, 100(4): 751-757.
Shariat et al., "An updated catalog of prostate cancer predictive tools," Cancer 2008, 113(11):3062-6.
Shen et al., "The SWI/SNF ATPase Brm is a gatekeeper of proliferative control in prostate cancer." Cancer Res. (Dec. 15, 2008) 68(24):10154-62.
Shibru et al., "Does the 3-gene diagnostic assay accurately distinguish benign from malignant thyroid neoplasms?" Cancer (Sep. 1, 2008) 113(5):930-5. doi: 10.1002/cncr.23703.
Shipley et al., "Radiation therapy for clinically localized prostate cancer: a multi-institutional pooled analysis," JAMA 1999, 281:1598-1604.
Simmons et al., "Natural history of biochemical recurrence after radical prostatectomy: risk assessment for secondary herapy," Eur Urol. (May 2007) 51(5):1175-84.
Singh et al., "LNA (locked nucleic acids): synthesis and high-affinity nucleic acid recognition," Chem Commun (1998) 4;455-456.
Singh et al., "Synthesis of 2'-amino-LNA: A novel conformationally restricted high-affinity oligonucleotide analogues with a handle," J Bio Chem (1998) 63:10035-10039.
Singh et al., "Gene expression correlates of clinical prostate cancer behavior," Cancer Cell (Mar. 2002) vol. 1, pp. 1203-1209.
Srikantan et al., "PCGEM1, a prostate-specific gene, is overexpressed in prostate cancer," PNAS (Oct. 24, 2000) 97(22): 12216-12221.
Taft et al., "Non-coding RNAs: regulators of disease," J Pathol, Jan. 2010, 220(2):126-39.
Taylor et al., "Integrative genomic profiling of human prostate cancer", Cancer Cell, Jul. 13, 2010, vol. 18 (1), pp. 11-22.
Thompson et al., "Adjuvant and Salvage Radiotherapy After Prostatectomy; AUA/ASTRO Guideline," J Urol., 2013 190(2):441-9.
Thorsen et al., "Alternative Splicing in Colon, Bladder, and Prostate Cancer Identified by Exon Array Analysis," Molecular & Cellular Proteomics (Mar. 18, 2008) vol. 7, No. 7, pp. 1214-1224.
Tockman et al., "Considerations in bringing a cancer biomarker to clinical application", Cancer Research, 1992, 52:2711-2718.
Tricoli et al., "Detection of prostate cancer and predicting progression: current and future diagnostic markers," Clinical Cancer Research (Jun. 15, 2004) 10:3943-3953.
True et al., "A molecular correlate to the Gleason grading system for prostate ladenocarcinoma," Proc Nati Acad Sci U S A. Jul. 18, 2006;103(29): 10991-6. Epub Jul. 7, 2006 preceding development of malignancy, J Clin Oncol. (Jul. 15, 2004) 22(14):2790-9.
Tsuchiya et al., "Mapping and gene expression profile of the minimally overrepresented 8q24 region in prostate cancer", Am J Pathol. (May 2002) 160(5):1799-1806.
Varambally et al., "Integrative Genomic and Proteomic Analysis of Prostate Cancer Reveals Signatures of Metastatic Progression," Cancer Cell (Nov. 2005) 8(5):393-406.
Varela et al., "Exome sequencing identifies frequent mutation of the SWI/SNF complex gene PBRM1 in renal carcinoma," Nature (Jan. 27, 2011) 469(7331):539-42.
Varricchi et al., "Are Mast Cells MASTers in Cancer?" Front Imrnunol. ePub (Apr. 12, 2017) 8:424.
Vickers et al., "Extensions to decision curve analysis, a novel method for evaluating diagnostic tests, prediction models and molecular markers," BMC Medical Informatics and Decision Making, (2008) 8(53)1-17.
Wang et al., "Two common chromosome 8q24 variants are associated with increased risk for prostate cancer," Cancer Res. (2007) 67:2944-2950.
Watson et al., "Future opportunities for the diagnosis and treatment of prostate cancer," Prostate Cancer Prostatic Dis. (2004) 7:S8-S13.
Weber et al., "The prognostic value of expression of HIF1 [alpha], EGFR and VEGF-A, in localized prostate cancer for intermediate-

(56) References Cited

OTHER PUBLICATIONS and high-risk patients treated with radiation therapy with or without androgen deprivation therapy"; Radiation Oncology (Apr. 30, 2012) vol. 7, No. 66, 8 pages.
Welsh et al., "Analysis of Gene Expression Identifies Candidate Markers and Pharmacological Targets in Prostate Cancer," Cancer Res. (Aug. 15, 2001) 61:5974-5978.
Wiegand et al., "ARID1A mutations in endometriosis-associated ovarian carcinomas", N Engl J Med. (Oct. 14, 2010) 363 (16):1532-43.
Yap et al., "Molecular interplay of the noncoding RNA ANRIL and methylated histone H3 lysine 27 by polycomb CBX7 n transcriptional silencing of INK4a", Mol Cell, (Jun. 11, 2010) 38(5):662-74.
Yates et al,, "X:Map: annotation and visualization of genome structure for Affymetrix exon array analysis," Nucleic Acids Res., (2008) vol. 36:D780-D786.
Yegnasubramanian et al., "DNA hypomethylation arises later in prostate cancer progression than CpG island hypermethylation and contributes to metastatic tumor heterogeneity", Cancer Res. Nov. 1, 2008; 68(21): pp. 8954-8967.
Yu et al., "Gene expression alterations in prostate cancer predicting tumor aggression and preceding development of malignancy," J Clin Oncol., (Jul. 15, 2004) 22(14):2790-2799.
Yu et al., "An integrated network of androgen receptor, polycomb, and TMPRSS2-ERG gene fusions in prostate cancer progression," Cancer Cell. (May 18, 2010) 17(5):443-54.
Yukinawa et al., "A multi-class predictor based on a probabilistic model: application to gene expression profiling-based diagnosis of thyroid tumors," BMC Genomics (Jul. 27, 2006) 7:190.
Zhao et al., "Development and validation of a 24-gene predictor of response to postoperative radiotherapy in prostate cancer: a matched, retrospective analysis," Lancet Oncol (2016) 17, pp. 1612-1620.
GenBank Accession No. AA462934 dated Jun. 10, 1997, 2 pages.
GenBank Accession No. AB028840 dated Jan. 12, 2000, 2 pages.
GenBank Accession No. AB030836 dated Oct. 2, 1999, 2 pages.
GenBank Accession No. AB036741 dated Dec. 22, 2000, 3 pages.
GenBank Accession No. AF077349 dated Dec. 14, 2000, 2 pages.
GenBank Accession No. AF077351 dated Dec. 20, 2000, 3 pages.
GenBank Accession No. AF115517 dated Nov. 23, 2005, 4 pages.
GenBank Accession No. AI413910 dated Feb. 9, 1999, 2 pages.
GenBank Accession No. AI414999 dated Feb. 9, 1999, 2 pages.
GenBank Accession No. A1425960 dated Mar. 9, 1999, 2 pages.
GenBank Accession No. A1851940 dated Jul. 15, 1999, 2 pages.
GenBank Accession No. AK018022 dated Sep. 19, 2008, 4 pages.
GenBank Accession No. AK019341 dated Sep. 19, 2008, 3 pages.
GenBank Accession No. AK019342 dated Sep. 19, 2008, 3 pages.
GenBank Accession No. AK142768 dated Sep. 19, 2008, 3 pages.
GenBank Accession No. AL591433 dated Jan. 15, 2009, 56 pages.
GenBank Accession No. BC004702 dated Jul. 15, 2006, 3 pages.
GenBank Accession No. BC055737 dated Jul. 15, 2006, 2 pages.
GenBank Accession No. BC086799 dated Sep. 21, 2006, 3 pages.
GenBank Accession No. BF449664 dated Dec. 1, 2000, 1 pages.
GenBank Accession No. BG063957 dated Jan. 26, 2001, 2 pages.
GenBank Accession No. 3G077309 dated Dec. 17, 2003, 2 pages.
GenBank Accession No. BM114282 dated Jan. 30, 2002, 2 pages.
GenBank Accession No. BY023910 dated Dec. 6, 2002, 2 pages.
GenBank Accession No. CN724527 dated May 18, 2004, 2 pages.
GenBank Accession No. NM_000130 dated Oct. 18, 2009, 6 pages.
GenBank Accession No. NM_000493 dated Mar. 15, 2009, 4 pages.
GenBank Accession No. NM_000598, GI No. 62243067, dated Jun. 6, 2010, 5 pages.
GenBank Accession No. NM_000688, GI No. 40316942, dated Nov. 4, 2010, 5 pages.
GenBank Accession No. NM_001013398; GI No. 62243247, dated Jun. 6, 2010, 5 pages.
GenBank Accession No. NM_001034 dated Oct. 5, 2009, 5 pages.
GenBank Accession No. NM_001039573, GI No. 221316683, dated Mar. 4, 2010, 5 pages.
GenBank Accession No. NM_001049 dated Jun. 21, 2009, 4 pages.
GenBank Accession No. NM_001067 dated Oct. 18, 2009, 5 pages.
GenBank Accession No. NM_001098533, GI No. 237858579, dated May 7, 2010, 5 pages.
GenBank Accession No. NM_001130851; GI No. 195927024, dated Mar. 5, 2010, 4 pages.
GenBank Accession No. NM_001136154 dated Jan. 8, 2012, 6 pages.
GenBank Accession No. NM_001136155 dated Jan. 8, 2012, 6 pages.
GenBank Accession No. NM_001143998, GI No. 221316675, dated Mar. 4, 2010, 5 pages.
GenBank Accession No. NM_001143999, GI No. 221316679, dated Mar. 5, 2010, 5 pages.
GenBank Accession No. NM_001144001, GI No. 221316686, dated Mar. 4, 2010, 5 pages.
GenBank Accession No, NM_001160367, GI No. 237858581, dated May 7, 2010, 5 pages.
GenBank Accession No. NM_001786 dated Nov. 1, 2009, 4 pages.
GenBank Accession No. NM_001844 dated Sep. 28, 2009, 7 pages.
GenBank Accession No. NM_003003, GI No. 221316681, dated Mar. 4, 2010, 5 pages.
GenBank Accession No. NM_003014; GI No. 170784837, dated Mar. 13, 2010, 5 pages.
GenBank Accession No. NM_003184; GI No. 115527086, dated Mar. 4, 2010, 7 pages.
GenBank Accession No. NM_003873.3 dated Oct. 18, 2009, 4 pages.
GenBank Accession No. NM_004336; GI No. 211938448, dated Mar. 14, 2010, 6 pages.
GenBank Accession No. NM_004449 dated Jan. 8, 2012, 6 pages.
GenBank Accession No. NM_005025.2 dated Jul. 12, 2009, 4 pages.
GenBank Accession No. NM_005192, GI No. 195927023, dated Mar. 4, 2010, 4 pages.
GenBank Accession No. NM_005651.1 dated Oct. 27, 2009, 3 pages.
GenBank Accession No. NM_006265, GI No. 208879448, dated Apr. 11, 2010, 6 pages.
GenBank Accession No. NM_006558 dated Aug. 21, 2009, 3 pages.
GenBank Accession No. NM_006727 dated Oct. 18, 2009, 3 pages.
GenBank Accession No. NM_006819; GI No. 110225356, dated May 17, 2010, 5 pages.
GenBank Accession No. NM_012152; GI No. 183396778, dated Apr. 5, 2010, 5 pages.
GenBank Accession No. NM_014846; GI No. 120952850, dated Mar. 4, 2010, 6 pages.
GenBank Accession No. NM_016623; GI No. 42734437, dated Mar. 29, 2009, 4 pages.
GenBank Accession No. NM_018930 dated Feb. 10, 2008, 4 pages.
GenBank Accession No. NM_031966 GI No. 34304372, dated Jun. 6, 2010, 5 pages.
GenBank Accession No. NM_032334; GI No. 223468686, dated Mar. 5, 2010, 3 pages.
GenBank Accession No. NM_052987, GI No. 237858574, dated May 17, 2010, 5 pages.
GenBank Accession No. NM_052988, GI No. 237858573, dated May 17, 2010, 5 pages.
GenBank Accession No. NM_080546; GI No. 112363101, dated May 17, 2010, 6 pages.
GenBank Accession No. NM_080607 dated Sep. 3, 2009, 2 pages.
GenBank Accession No. NM_133445 dated Sep. 20, 2009, 5 pages.
GenBank Accession No. NM_138455; GI No. 34147546, dated May 7, 2010, 3 pages.
GenBank Accession No. NM_182918 dated Jan. 8, 2012, 6 pages.
GenBank Accession No. NM_199166, GI No. 40316938, dated Apr. 11, 2010, 5 pages.
GenBank Accession No. NP_001058 dated Dec. 25, 2011, 9 pages.
GenBank Accession No. W34764 dated May 13, 1996, 2 pages.
Supplemental Table 1 of U.S. Appl. No. 61/057,698, filed May 30, 2008, 13 pages.
Supplemental Table 2 of U.S. Appl. No. 61/057,698, filed May 30, 2008, 15 pages.
Supplemental Table 3 of U.S. Appl. No. 61/057,698, filed May 30, 2008, 21 pages.

(56) References Cited

OTHER PUBLICATIONS

Supplemental Table 4 of U.S. Appl. No. 61/057,698, filed May 30, 12008, 1 page.
Supplemental Table 5 of U.S. Appl. No. 61/057,698, filed May 30, 12008, 2 pages.
Supplemental Table 6 of U.S. Appl. No. 61/057,698, filed May 30, 2008, 1 page.
Affymetrix: Data Sheet, "GeneChip® Exon Array System for Human, Mouse, and Rat," Internet Citation, [Online] Jan. 25, 2012 [Retrieved from the Internet] Intp://www.biainformatics.atickland. aciaz/workshops/1O_March_2011 1 Exon_EOST_Datash eet.pdf, 8 pages.
Bibikova et al., "Expression signatures that correlated with Gleason score and relapse in prostate cancer," Genomics (2007) 89(6):666-672.
Chen et al., "Hepsin and maspin are inversely expressed in laser capture microdissectioned prostate cancer," J Urol. (Apr. 2003) 169(4):1316-1319.
Dahlman et al., "Effect of androgen deprivation therapy on the expression of prostate cancer biomarkets MSMB and MSMB-binding protein CRISP3," Prostate Cancer and Prostatic Diseases (2010) 13:369-375.
Dechassa et al., "Architecture of the SWI/SNF-nucleosome complex," Mol Cell Biol. (Oct. 2008) vol. 28, No. 19, pp. 6010-6021.
Edwards et al., "Expression analysis onto microarrays of randomly selected cDNA clones highlights HOXB13 as a marker of human prostate cancer," Br J Cancer. (Jan. 31, 2005) 92(2):376-381.
Etzioni et al. "The case for early detection", Nature Reviews | Cancer (Apr. 2003) vol. 3, pp. 1-10.
Fryknas et al., "Molecular markers for discrimination of benign and malignant follicular thyroid tumors," Tumour Biol. (May 2, 2006) 27(4):211-20.
Galamb et al., "Diagnostic mRNA Expression Patterns of Inflamed, Benign, and Malignant Colorectal Biopsy Specimen and their Correlation with Peripheral Blood Results," Cancer Epidemiology, Biomarkers & Prevention (Oct. 2008) 17(10):2835-2845.
Giordano et al., "Organ-Specific Molecular Classification of Primary Lung, Colon, and Ovarian Adenocarcinomas Using Gene Expression Profiles," Am J Pathol (2001) 159(4):1231-1238.
Ida et al., "Topoisomerase II alpha protein expression Is predictive of outcome in Gleason score 7 prostate cancer patients treated surgically and is dependent on ERG status." Mod Pathol. (Feb. 2010) Abstract 1895, 23 : 424A-425A.
Jenkins et al., "Prognostic significance of ailetic imbalance of chromosome arms 71, 8p, 16q, and 18q in stage T3NOMO prostate cancer," Genes, Chromosomes & Cancer (1998) 21:131-143.
Karayi et al., "Molecular biology of prostate cancer," Prostate Cancer Prostatic Dis. (2004) 7(1):6-20.
Karnes et al., "Radical prostatectomy for high-risk prostate cancer," Jpn. J. Clin. Oneal. (Oct. 19, 2009) 40 (1): 3-9, Epub.
Karnes et al., "The ability of biomarkers to predict systemic progression in men with high-risk prostate cancer treated surgically is dependent on ERG status," Cancer Res. (Nov. 9, 2010) 70(22):8994-9002, Epub.
Kawamorita et al., "Radical prostatectomy for high-risk prostate cancer: Biochemical outcome," International Journal of Urology (2009) 16:733-738.
Kishi et al., "Expression of the survivin gene in prostate cancer: correlation with clinicopathological characteristics, proliferative activity and apoptosis," J Urol. (May 2004) 171(5): 1855-1860.
Klee et al., "Candidate Serum Biomarkers for Prostate Adenocarcinoma identified by mRNA Differences in Prostate Tissue and Verified with Protein Measurements in Tissue and Blood," Clinical Chemistry (2012) 58(3):599-609.
Kumar-Sinha et al., "Molecular markers to identify patients at risk for recurrence after primary treatment for prostate cancer," Urology, 62 Suppl 1:19-35, Dec. 29, 2003.
Liong et al., "Blood-Based Biomarkers of Aggressive Prostate Cancer," PLoS ONE (Sep. 2012) vol. 7, Issue 7, e45802, pp. 1-7.

Lunardi et al., "A co-clinical approach identified mechanisms and potential therapies for androgen deprivation resistance in prostate cancer," Nature Genetics (Jul. 2013) vol. 45, No. 7, pp. 747-757.
Luo et al., "Human Prostate Cancer and Benign Prostatic Hyperplasia : Molecular Dissection by Gene Expression Profiling," Cancer Res. (2001) 61:4683-4688.
Mühlenbruch et al., "Multiple imputation was a valid approach to estimate absolute risk from a prediction model based on case—cohort data," Journal of Clinical Epidemiology (2017) 84:130-141.
Ong et al., "Expression Profiling Identifies a Novel-Methylacyl-CoA Racemase Exon with Fumarate Hydratase Homology," Cancer Research (Jun. 15, 2003) 63:3296-3301.
Perez et al., "Long, abundantly expressed non-coding transcripts are altered in cancer," Human Molecular Genetics (2008) vol. 17, No. 5, pp. 642-655. *Advanced Access* published on Nov. 15, 2007.
Rotunno et al., "A Gene Expression Signature from Peripheral Whole Blood for Stage I Lung Adenocarcinoma," Cancer Prevention Research (Jul. 8, 2011) 4(10) 1599-1607.
Stanbrough et al., "Increased Expression of Genes Converting Adrenal Androgens to Testosterone in Androgen-Independent Prostate Cancer," Cancer Res (Mar. 1, 2006) 66(5):2815-2825.
Stephenson et al., "Integration of gene expression profiling and clinical variables to predict prostate carcinoma recurrence after radical prostatectomy," Cancer (Jul. 15, 2005) 104(2):290-298.
Subramanian et al., "Gene set enrichment analysis: a knowledge-based approach for interpreting genome-wide expression profiles," PNAS USA (2005) 102:15545-15550.
Takayama et al., "TACC2 Is an Androgen-Responsive Cell Cycle Regulator Promoting Androgen-Mediatged and Castration-Resistant Growth of Prostate Cancer," Mol Endocrinol (May 2012) 26(5):748-761.
Tomlins et al., "TMPRSS2:ETV4 Gene Fusions Define a Third Molecular Subtype of Prostate Cancer," Cancer Res. (2006) 66:3396-3400.
Tomlins et al., "Distinct classes of chromosomal rearrangements create oncogenic ETS gene fusions in prostate cancer," Nature (Aug. 2, 2007) 448(7153):595-9.
Vanaja et al., "Transcriptional Silencing of Zinc Finger Protein 185 Identified Profiling Is Associated with Prostate Cancer Progression," Cancer Research (Jul. 15, 2003) 63:3877-3882.
Vanaja et al., "PDLIM4 Represseion by Hypermethylation as a Potential Biomarker for Prostate Cancer," Clin. Cancer Res. (2006) 12(4):1128-1136.
GenBank Accession No. AK034387 dated Sep. 19, 2008, 4 pages.
GenBank Accession No. AK038229 dated Sep. 19, 2008, 4 pages.
GenBank Accession No. AK038434 dated Sep. 19, 2008, 4 pages.
GenBank Accession No. AK041534 dated Sep. 19, 2008, 4 pages.
GenBank Accession No. AK042683 dated Sep. 19, 2008, 4 pages.
GenBank Accession No. AK136096 dated Sep. 19, 2008, 4 pages.
GenBank Accession No. AK136101 dated Sep. 19, 2008, 4 pages.
Cho et al., "Hypermethylation of CpG island loci and hypomethylation of LINE-1 and Alu repeats in prostate denocarcinoma and their relationship to clinicopathological features", J Pathol (Feb. 2007) 211(3):269-77.
Gleave et al., "Randomized comparative study of 3 versus 8-month neoadjuvant hormonal therapy before radical orostatectomy : biochemical and pathological effects," J Urol. (2001) 166:500-507.
Henrotin et al.: "Type II collagen peptides for measuring cartilage degradation," Biotheology (2004) 41 (3-4): Abstract.
Lawton et al., "Updated results of the phase III Radiation Therapy Oncology Group (RTOG) trial 85-31 evaluating the potential benefit of androgen suppression following standard radiation therapy for unfavorable prognosis carcinoma of the prostate," Int J Rad Oncol Biol Phvs. (2001) 49:937-946.
Porkka et al., "RAD21 and KIAA0196 at 8q24 are amplified and overexpressed in prostate cancer," Genes Chromosomes Cancer (2004) 39:1-10.
Rowley, "A new Consistent Chromosomal Abnormal ity in Chronic Myelogenous Leukaemia Identified by Quinacrine rluorescence and Giemsa Staining," Nature (Jun. 1, 1973) 243:290-293.
Sandler et al., "Overall survival after prostate-specific-antigen-detected recurrence following conformal radiation therapy," Int J Rad Oncol Biol Phvs. (2000) 48:629-633.

(56) References Cited

OTHER PUBLICATIONS

Sun et al., "Aberrant expression of SWI/SNF catalytic subunits BRG1/BRM is associated with tumor development and ncreased invasiveness in prostate cancers," Prostate (Feb. 1, 2007) 67(2):203-13.
Zelefsky et al., "Neoadjuvant hormonal therapy improves the therapeutic ratio in patients with bulky prostatic cancer treated with three-dimensional conformal radiation therapy," Int J Radiat Oncol Biot Phvs. (1994) 29:755-761.
Adamo and Ladomery, "The Oncogene ERG: A Key Factor in Prostate Cancer," *Oncogene*(2016), 35:403-414.
Affymetrix GeneChip Human Genome U133 Array Set HG-U133A, Geo, Mar. 11, 2002, retrieved on Mar. 11, 2002.
Alberts et al., "Vesicular traffic in the secretory and endocytic pathways," Molecular Biology of the Cell (1994) 3rd Ed., p. 465.
Amling et al.: "Long-term hazard of progression after radical prostatectomy for clinically EB localized prostate cancer continued risk of biochemical failure after 5 years," J Urol. (2000) 164:101-105.
Amundadottir et al., "A common variant associated with prostate cancer in European and African populations," Nat Genet. (2006) 38:652-658.
Anonymous, UCSC Genome Browser on Human Mar. 2006, NCBI36/hg18) Assembly, Mar. 2006, XP055587638, Retrieved from the Internet: URL:https://genome-euro.ucsc.edu/cgi-bin/hgTracks?db=hg18&lastVirtModeType=default&lastVirtModeExtraState=&virtModeType=default&virtMode=0&nonVirtPosition=&position=chr5%3A 14025126%2D14062770&hgsid=232148223_IYIy9VS0Lh0jhldEBQ3nViBrQuB5 [retrieved on May 10, 2019].
Baggerly et al., "Deriving Chemosensitivity from Cell Lines: Forensic Bioinformatics and Reproducible Research in High-Throughput Biology," The Annals of Applied Sciences (2009) vol. 3, No. 4, pp. 1309-1334.
Benner et al., "Evolution, language and analogy in functional genomics," TRENDS in Genetics, (Jul. 2001) vol. 17, pp. 414-418.
Bismar et al., "ERG Protein Expression Reflects Hormonal Treatment Response and is Associated with Gleason Score and Prostate Cancer Specific Mortality," *Eur. J. Cancer* (2012), 48:538-546,Elsevier Ltd.
Biton et al., Nov. 20, 2014, Independent component analysis uncovers the landscape of the bladder tumor transcriptome and reveals insights into luminal and basal subtypes, Cell Reports, 9(4):1235-1245.
Blute et al., "Use of Gleason score, prostate specific antigen, seminal vesicle and margin status to predict biochemical failure after radical prostatectomy," J Urol (2001) 165: 119-125.
Erase et al., "TMPRSS2-ERG-specific transcriptional modulation is associated with prostate cancer biomarkers and TGF-β signaling," BMC Cancer (2011) 11(507):1-8.
Bueno et al., "A diagnostic test for prostate cancer from gene expression profiling data," J Urol, Feb. 2004; 171(2 Pt 1):903-6.
Carninci et al., "The transcriptional landscape of the mammalian genome," Science (Sep. 2, 2005) 09(5740):1559-63.
Cheung et al., "Natural variation in human gene expression assessed in lymphoblastoid cells," Nature Genetics (2003) vol. 33, pp. 422-425.
Cho et al., "Hypermethylation of CpG island loci and hypomethylation of LINE-1 and Alu repeats in prostate adenocarcinoma and their relationship to clinicopathological features", J Pathol (Feb. 2007) 211(3):269-77.
Choi et al., Feb. 2014, Identification of distinct basal and luminal subtypes of muscle-invasive bladder cancer with different sensitivities to frontline chemotherapy, Cancer Cell, 25(2):152-165.
Cologne et al., "Optimal Case-Control Matching in Practice," Epidemiology Resources Inc. (1995) 6(3):271-275.
Cooper et al., "Mechanisms of Disease: biomarkers and molecular targets from microarray gene expression studies in prostate cancer ," Nat Clin Pract Urol. (2007) Dee:4(12):677-87.

Cordon-Cardo et al., "Improved prediction of prostate cancer recurrence through systems pathology," the Journal of Clinical Investigation (Jul. 2007) vol. 117, No. 7, pp. 1876-1883.
Couzin-Frankel, Jennifer, "As Questions Grow, Duke Halts Trials, Launches Investigation," Science (Aug. 6, 2010) vol. 329, pp. 614-615.
D'Amico et al., "Determinants of prostate cancer-specific survival after radiation therapy for patients with clinically localized prostate cancer," J Clin Oncol. (2002) 20:4567-4573.
De Klein et al., "A cellular oncogene is translocated to the Philadelphia chromosome in chronic myelocytic leukaemia." Nature (Dec. 23, 1982) 300(5894):765-7.
De Marzo et al., "Pathological and molecular mechanisms of prostate carcinogenesis: implications for diagnosis, detection, prevention, and treatment," J Cell Biochem. (Feb. 15, 2004) 91(3):459-477.
Den et al., Mar. 10, 2015, Genomic classifier identifies men with adverse pathology after racial prostatectomy who benefit from adjuvant radiation therapy, Journal of Clinical Oncology, 33(8):944-951.
Epstein et al., "Prognostic factors and reporting of prostate carcinoma in radical AU prostatectomy and pelvic lymphadenectomy specimens," Scand. J. Urol. Nephrol. Suppl. (2005) 216:34-63.
Feng et al., "Luminal and basal subtyping of prostate cancer," *J Clin Oncol* (Feb. 20, 2017) vol. 35, No. 6, p. 3, Abstract.
Feroze-Merzoug et al., "Molecular profiling in prostate cancer," Cancer Metastasis Rev. 1 (2001) 20(3-4):165-71.
Fine et al., "A Proportional Hazards Model for the Subdistribution of a Competing Risk," Journal of the American Statistical Association (1999) vol. 94 (446), pp. 496-509.
Fu et al., "Regulation of apoptosis by a prostate-specific and prostate cancer-associated noncoding gene, PCGEM1." DNA Cell Biol. (Mar. 2006) 25(3): 135-41.
Galavotti et al., Apr. 2012, the autophagy-associated factors DRAM1 and p62 regulate cell migration and invasion in glioblastoma stem cells, Oncogene, 32:699-712.
Garber et al., "Diversity of gene expression in adenocarcinoma of the lung," PNAS (Nov. 20, 2001) vol. 98, No. 24, pp. 13784-13789.
Gleason: "Histologic grading and clinical staging of prostatic carcinoma", Urologic pathology: the prostate, (Tannenbaum, ed.) (1977) Lea & Febiger, Philadelphia, PA, pp. 171-197.
Gleason: "Histologic grading of prostate cancer: a perspective"; Hum. Pathol. (1992) 23(3):273-279.
Gleave et al., "Randomized comparative study of 3 versus 8-month neoadjuvant hormonal therapy before radical prostatectomy : biochemical and pathological effects," J Urol. (2001) 166:500-507.
Gonzalgo et al: "Molecular pathways to prostate cancer"; J Urol. (2003) 170(6 Pt 1):2444-2452.
Grambsch et al., "Proportional Hazards Tests and Diagnostics Based on Weighted Residuals," Biometrika (2013) vol. 81 (3), pp. 515-526.
Heagerty et al., "Time-Dependent ROC Curves for Censored Survival Data and a Diagnostic Marker," Biometrics (2000) vol. 56 (2), pp. 337-344.
Henrotin et al.: "Type II collagen peptides for measuring cartilage degradation," Biorheology (2004) 41 (3-4): Abstract.
Humphrey et al: "Histologic grade, DNA ploidy, and intraglandular tumor extent as indicators of tumor progression of clinical Stage B prostatic carcinoma"; Am J Surg Pathol (1991) 15(12):1165-1170.
Ito et al., "Linkage of elevated ets-2 expression to hepatocarcinogenesis," Anticancer Research (2002) 22(4):2385-2389.
Jemal et al.: "Cancer statistics," CA Cancer J Clin. (2005) 55:10-30.
Jhavar et al., "Technical Advance: Detection of TMPRSS2-ERG Translocations in Human Prostate Cancer by Expression Profiling Using GeneChip Human Exon 1.0 ST Arrays," J Mol. Diag (Jan. 2008) vol. 10, No. 1, pp. 50-57.
Jones et al., "Frequent mutations of chromatin remodeling gene ARID1A in ovarian clear cell carcinoma" Science (Oct. 8, 2010) 330(6001):228-31.
Karan et al., "Current status of the molecular genetics of human prostatic adenocarcinomas," Int J Cancer, 2003, 103(3):285-293.
Kestin, "Potential survival advantage with early androgen deprivation for biochemical failure after external beam radiotherapy: the

(56) References Cited

OTHER PUBLICATIONS importance of accurately defining biochemical disease status," Int J Rad Oncol Biol Phys. (2004) 60:453-62.

Kunarso et al., "Transposable elements have rewired the core regulatory network of human embryonic stem cells," Nat Genet (Jul. 2010) 42(7):631-4.

Lawton et al., "Updated results of the phase III Radiation Therapy Oncology Group (RTOG) trial 8531 evaluating the potential benefit of androgen suppression following standard radiation therapy for unfavorable prognosis carcinoma of the prostate," Int J Rad Oncol Biol Phys. (2001) 49:937-946.

Leyten et al., "Identification of a Candidate Gene Panel for the Early Diagnosis of Prostate Cancer," Clinical Cancer Research (2015) 21(13):3061-3070.

Lin et al., "Cox Regression with Incomplete Covariate Measurements," Journal of the American Statistical Association (1993) vol. 88 (424), pp. 1341-1349.

Liu et al., 2014, Synergistic killing of lung cancer cells by cisplatin and radiation via autophagy and apoptosis, Oncology Letters, 7:1903-1910.

Livingston et al., "*Homo sapiens* CDC20 Cell Division Cycle 20 Homolog (CDC20)," Gene (Apr. 24, 2006).

McConkey et al., Apr. 2015, Therapeutic opportunities in the intrinsic subtypes of muscle-invasive bladder cancer, Hematology/Oncology Clinics of North America, 29(2):377-394.

McConkey et al., May 2016, A prognostic gene expression signature in the molecular classification of chemotherapy-naïve urothelial cancer is predictive of clinical outcomes from neoadjuvant chemotherapy: a phase 2 trial of dose-dense methotrexate, vinblastine, doxorubicin, and cisplatin with bevacizumab in urothelial cancer, European Urology, 69(5):855-862.

Mendiratta et al., "Genomic signatures associated with the development, progression, rand outcome of prostate cancer," Molecular diagnosis & therapy (2007) 11(6):345-54.

Mercer, DW, "Use of multiple markers to enhance clinical utility", Immunol Ser. (1990) 53: 39-54.

Mitelman, "Recurrent chromosome aberrations in cancer," Mutation Research (2000) 462: 247-253.

Montironi et al., "Carcinoma of the prostate: inherited susceptibility, somatic gene defects and androgen receptors," Virchows Arch. (Jun. 2004) 444(6):503-508.

Moul et al., "Early versus delayed hormonal therapy for prostate specific antigen only recurrence of prostate cancer after radical prostatectomy," J Urol. (2004) 171:1141- 1147.

Moul, "Prostate specific antigen only progression of prostate cancer," J Urol. (2000) 163:1632-42.

Nelson, "Predicting prostate cancer behavior using transcript profiles," J Urol. (Nov. 2004) 172(5 Pt 2):S28-32; discussion S33.

Ohl et al., "Gene expression studies in prostate cancer tissue: which reference gene should be selected for normalization'?," J. Mol. Med . (2005) 83(12):1014-1024.

Oosumi et al., "Mariner transposons in humans", Nature (Dec. 14, 1995) 378 (6558): 672.

Ozen et al., Sep. 24, 2007, Widespread deregulation of microRNA expression in human prostate cancer, Oncogene, 27:1788-1793.

Paulo et al., "Molecular Subtyping of Primary Prostate Cancer Reveals Specific and Shared Target Genes of Different ETS Rearrangements," Neoplasia (Jul. 2012) 14(7):600-611.

Porkka et al., "RAD21 and KIAA0196 at 8q24 are amplified and overexpressed in prostate cancer," Genes Chromosomes Cancer (2007) 39:1-10.

Probe Set Listing for the Affymetrix Human Genome U133 Plus 2.0 array (Accessed from https://www.affymetrix.com/analysis/index.affx on Jul. 1, 2015) (Year: 2015).

Rabbits, "Chromosomal translocations in human cancer", Nature (Nov. 10, 1994) 372: 143-149.

Reddy et al., "Clinical utility of microarray-derived genetic signatures in predicting outcomes in prostate cancer," Clinical Genitourinary Cancer (2006) 5(3):187-189.

Roberts et al., "The SWI/SNF complex-chromatin and cancer." Nat Rev Cancer (Feb. 2004) 4(2):133-42.

Robertson et al., "Reconstructing the ancient mariners of humans." Nat Genet. (Apr. 1996) 12(4):360-1.

Ross et al., "Tissue-based Genomics Augments Post-prostatectomy Risk Stratification in a Natural History Cohort of Intermediate- and High-Risk Men," European Urology 69 (2016) pp. 157-165.

Rowley, "A new Consistent Chromosomal Abnormal ity in Chronic Myelogenous Leukaemia Identified by Quinacrine fluorescence and Giemsa Staining," Nature (Jun. 1, 1973) 243:290-293.

Rowley, "Chromosome translocations: dangerous liaisons revisited," Nature Reviews: Cancer (Dec. 2001) 1):245-250.

Saito-Hisaminato et al., "Genome-Wide Profiling of Gene Expression in 29 Normal Human Tissues with a cDNA Microarray," DNA Research (2002) vol. 9, pp. 35-45.

Saligan et al., "Supervised Classification by Filter Methods and Recursive Feature Elimination Predicts Rick of Radiotherapy-Related Fatigue in Patients with Prostate Cancer," Cancer Informatics (2014) 13: 141-152.

Sandler et al., "Overall survival after prostate-specific-antigen-detected recurrence following conformal radiation therapy," Int J Rad Oncol Biol Phys. (2000) 48:629-633.

Savinainen et al., "Over expression of EIF3S3 promotes cancer cell growth," The Prostate (2006) 66: 1144-1150.

Schlomm et al., "Molecular staging of prostate cancer in the year 2007," World .J. Urol. (Mar. 2007) 25(1):19-30.

Schmidt et al., "Lack of interferon consensus sequence binding protein (ICSBP) transcripts in human myeloid leukemias," Blood (1998) 91:22-29.

Seiler et al., Oct. 2017, Impact of molecular subtypes in muscle-invasive bladder cancer on predicting response and survival after neoadjuvant chemotherapy, European Urology, 72(4):544-554.

Slotkin et al., "Transposable elements and the epigenetic regulation of the genome." Nat Rev Genet. (Apr. 2007) 8(4):272-85.

Smit et al., "High-Resolution ERG-Expression Profiling on GeneChip Exon 1.0 ST Arrays in Primary and Castration-Resistant Prostate Cancer," *BJU International* (2013), 111(5):836-842, BJU International.

Solo et al., "Prevalence of prostate cancer (PC) clinical states (CS) in the United States: Estimates using a dynamic progression model," ASCO Annual Meeting, Journal of Clinical Oncology (May 20, 2011) vol. 29, No. 15, Abstract 4637.

Stamey et al., "Molecular genetic profiling of Gleason grade 415 prostate cancers compared to benign prostatic hyperplasia," J Urol. (2001) 166(6):2171-2177.

Stavenhagen et al., "An ancient provirus has imposed androgen regulation on the adjacent mouse sex-limited protein Jene." Cell (Oct. 21, 1988) 55(2):247-54.

Stephenson et al., "Postoperative Nomogram Predicting the 10-Year Probability of Prostate Cancer Recurrence After Radical Prostatectomy," J Clin Oncol (2008) vol. 23 (28), pp. 7005-7012.

Sun et al., "Aberrant expression of SWI/SNF catalytic subunits BRG1/BRM is associated with tumor development and increased invasiveness in prostate cancers," Prostate (Feb. 1, 2007) 67(2):203-13.

Talantov et al., "Gene Based Prediction of Clinically Localized Prostate Cancer Progression After Radical Prostatectomy," The Journal of Urology (Oct. 2010) vol. 184, 1521-1528.

Thompson et al., "Is the GPSM scoring algorithm for patients with prostate cancer valid in the contemporary era?" J Urol. (Aug. 2007) vol. 178 (2), 459-463.

Tollefson et al., "Stratification of Patient Risk Based on Prostate-Specific Antigen Doubling Time After Radical Retropubic Prostatectomy," Mayo Clin Proc. (2007) 82:422-427.

Tsuchiya et al., "Clinical significance in situ hybridization analysis in pathologic of alterations of chromosome 8 detected by fluorescence organ-confined prostate cancer," Genes Chromosomes Cancer (2002) 34:363-371.

Versteege et al., "Truncating mutations of hSNF5/INI1 in aggressive paediatric cancer." Nature (Jul. 9, 1998) 394 6689):203-6.

Visakorpi, "The molecular genetics of prostate cancer," Urology (2003) 62(5 Suppl 1):3-10.

(56) References Cited

OTHER PUBLICATIONS

Willman et al., "Immunohistochemical staining for DNA topoisomerase II-alpha in benign, premalignant, and malignant lesions of the prostate," Prostate (Mar. 1, 2000) 42(4):280-286.

Winkler et al.: "Stage D1 prostatic adenocarcinoma: significance of nuclear DNA ploidy patterns studied by flow cytometry," Mayo Clin Proc. (1988) 63(2): 103-112.

Wyatt et al., "Heterogeneity in the inter-tumor transcriptome of high risk prostate cancer," *Genome Biology* (Aug. 26, 2014) vol. 15, No. 8, pp. 2-14.

Yeager et al., "Genome-wide association study of prostate cancer identifies a second risk locus at 8q24," Nat Genet (2007) 39:645-649.

Yeliin et al., "Widespread occurrence of antisense transcription in the human genome," Nat Biotechnol. (2003) 21(4):379-86.

Zanetta et al., "Flow-cytometric analysis of deoxyribonucleic acid content in advanced ovarian carcinoma: its importance in long-term survival," Am J Obstet Gynecol (1996) 175(5): 1217-1225.

Zelefsky et al., "Neoadjuvant hormonal therapy improves the therapeutic ratio in patients with bulky prostatic cancer treated with three-dimensional conformal radiation therapy," Int J Radiat Oncol Biot Phys. (1994) 29:755-761.

Choi et al., Jun. 24, 2014, Intrinsic basal and luminal subtypes of muscle-invasive bladder cancer, Nature Reviews Urology, 11(7):400-410.

Dhani et al., 2011, Phase II study of cytarabine in men with docetaxel-refractory, castration-resistnt prostate cancer with evaluation of TMPRSS2-ERG and SPINK1 as serum biomarkers, BJUI, 110:840-845.

Ha et al., Nov. 12, 2009, Comparison of affymetrix gene array with the exon array shows potential application for detection of transcript isoform variation, BMC Genomics, 19(1):519.

Knowles et al., Dec. 23, 2014, Molecular biology of bladder cancer: new insights into pathogenesis and clinical diversity, Nature Reviews Cancer, 15(1):25-41.

Warrick et al., 2016, FOXA1, GATA3 and PPARγ cooperate to drive luminal subtype in bladder cancer: a molecular analysis of established human cell lines, Scientific Reports, 6:38531, DOI: 10.1038, 15 pp.

\* cited by examiner

CANCER DIAGNOSTICS USING BIOMARKERS

CROSS REFERENCE TO RELATED APPLICATION

This application claims the benefit of priority under § 119(e) of U.S. Ser. No. 61/684,066 filed Aug. 16, 2012, U.S. Ser. No. 61/764,365 filed Feb. 13, 2013 and U.S. Ser. No. 61/783,124, filed Mar. 14, 2013, the entire contents of each are herein incorporated by reference.

BACKGROUND OF THE INVENTION

Cancer is the uncontrolled growth of abnormal cells anywhere in a body. The abnormal cells are termed cancer cells, malignant cells, or tumor cells. Many cancers and the abnormal cells that compose the cancer tissue are further identified by the name of the tissue that the abnormal cells originated from (for example, breast cancer, lung cancer, colon cancer, prostate cancer, pancreatic cancer, thyroid cancer). Cancer is not confined to humans; animals and other living organisms can get cancer. Cancer cells can proliferate uncontrollably and form a mass of cancer cells. Cancer cells can break away from this original mass of cells, travel through the blood and lymph systems, and lodge in other organs where they can again repeat the uncontrolled growth cycle. This process of cancer cells leaving an area and growing in another body area is often termed metastatic spread or metastatic disease. For example, if breast cancer cells spread to a bone (or anywhere else), it can mean that the individual has metastatic breast cancer.

Standard clinical parameters such as tumor size, grade, lymph node involvement and tumor-node-metastasis (TNM) staging (American Joint Committee on Cancer www.cancerstaging.org) may correlate with outcome and serve to stratify patients with respect to (neo)adjuvant chemotherapy, immunotherapy, antibody therapy and/or radiotherapy regimens. Incorporation of molecular markers in clinical practice may define tumor subtypes that are more likely to respond to targeted therapy. However, stage-matched tumors grouped by histological or molecular subtypes may respond differently to the same treatment regimen. Additional key genetic and epigenetic alterations may exist with important etiological contributions. A more detailed understanding of the molecular mechanisms and regulatory pathways at work in cancer cells and the tumor microenvironment (TME) could dramatically improve the design of novel anti-tumor drugs and inform the selection of optimal therapeutic strategies. The development and implementation of diagnostic, prognostic and therapeutic biomarkers to characterize the biology of each tumor may assist clinicians in making important decisions with regard to individual patient care and treatment. Thus, disclosed herein are methods, compositions and systems for the analysis of coding and non-coding targets for the diagnosis, prognosis, and monitoring of a cancer.

This background information is provided for the purpose of making known information believed by the applicant to be of possible relevance to the present invention. No admission is necessarily intended, nor should be construed, that any of the preceding information constitutes prior art against the present invention.

SUMMARY OF THE INVENTION

Disclosed herein in some embodiments is a method of diagnosing, prognosing, determining progression the cancer, or predicting benefit from therapy in a subject, comprising (a) assaying an expression level in a sample from the subject for a plurality of targets, wherein the plurality of targets comprises one or more targets selected from Tables 2, 4, 11 or 55; and (b) diagnosing, prognosing, determining progression the cancer, or predicting benefit from therapy in a subject based on the expression levels of the plurality of targets. In some embodiments, the cancer is selected from the group consisting of a carcinoma, sarcoma, leukemia, lymphoma, myeloma, and a CNS tumor. In some embodiments, cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a thyroid cancer. In some embodiments, the plurality of targets comprises a coding target. In some embodiments, the coding target is an exonic sequence. In some embodiments, the plurality of targets comprises a non-coding target. In some embodiments, the non-coding target comprises an intronic sequence or partially overlaps an intronic sequence. In some embodiments, the non-coding target comprises a sequence within the UTR or partially overlaps with a UTR sequence. In some embodiments, the non-coding target comprises an antisense sequence or partially overlaps with an antisense sequence. In some embodiments, the non-coding target comprises an intergenic sequence or partially overlaps with an intergenic sequence. In some embodiments, the target comprises a nucleic acid sequence. In some embodiments, the nucleic acid sequence is a DNA sequence. In some embodiments, the nucleic acid sequence is an RNA sequence. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the diagnosing, prognosing, determining progression the cancer, or predicting benefit from therapy includes determining the malignancy of the cancer. In some embodiments, the diagnosing, prognosing, determining progression the cancer, or predicting benefit from therapy includes determining the stage of the cancer. In some embodiments, the diagnosing, prognosing, determining progression the cancer, or predicting benefit from therapy includes assessing the risk of cancer recurrence. In some embodiments, determining the treatment for the cancer includes determining the efficacy of treatment. In some embodiments, the method further comprises sequencing the plurality of targets. In some embodiments, the method further comprises hybridizing the plurality of targets to a solid support. In some embodiments, the solid support is a bead or array. In some embodiments, assaying the expression level of a plurality of targets may comprise the use of a probe set. In some embodiments, assaying the expression level may comprise the use of a classifier. The classifier may comprise a probe selection region (PSR). In some embodiments, the classifier may comprise the use of an algorithm. The algorithm may comprise a machine learning algorithm. In some embodiments, assaying the expression level may also comprise sequencing the plurality of targets.

Disclosed herein in some embodiments is a method of determining a treatment for a cancer in a subject, comprising (a) assaying an expression level in a sample from the subject for a plurality of targets, wherein the plurality of targets comprises one or more targets selected from Tables 2, 4, 11 or 55; and (b) determining the treatment for the cancer based on the expression level of the plurality of targets. In some embodiments, the cancer is selected from the group consisting of a carcinoma, sarcoma, leukemia, lymphoma, myeloma, and a CNS tumor. In some embodiments, cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a thyroid cancer. In some embodiments, the plurality of targets comprises a coding target. In some embodiments, the coding target is an exonic sequence. In some embodiments, the plurality of targets comprises a non-coding target. In some embodiments, the non-coding target comprises an intronic sequence or partially overlaps an intronic sequence. In some embodiments, the non-coding target comprises a sequence within the UTR or partially overlaps with a UTR sequence. In some embodiments, the target comprises a nucleic acid sequence. In some embodiments, the nucleic acid sequence is a DNA sequence. In some embodiments, the nucleic acid sequence is an RNA sequence. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the diagnosing, prognosing, determining progression the cancer, or predicting benefit from therapy includes determining the malignancy of the cancer. In some embodiments, the diagnosing, prognosing, determining progression the cancer, or predicting benefit from therapy includes determining the stage of the cancer. In some embodiments, the diagnosing, prognosing, determining progression the cancer, or predicting benefit from therapy includes assessing the risk of cancer recurrence. In some embodiments, determining the treatment for the cancer includes determining the efficacy of treatment. In some embodiments, the method further comprises sequencing the plurality of targets. In some embodiments, the method further comprises hybridizing the plurality of targets to a solid support. In some embodiments, the solid support is a bead or array. In some embodiments, assaying the expression level of a plurality of targets may comprise the use of a probe set. In some embodiments, assaying the expression level may comprise the use of a classifier. The classifier may comprise a probe selection region (PSR). In some embodiments, the classifier may comprise the use of an algorithm. The algorithm may comprise a machine learning algorithm. In some embodiments, assaying the expression level may also comprise amplifying the plurality of targets. In some embodiments, assaying the expression level may also comprise quantifying the plurality of targets.

Further disclosed herein in some embodiments is a probe set for assessing a cancer status of a subject comprising a plurality of probes, wherein the probes in the set are capable of detecting an expression level of one or more targets selected from Tables 2, 4, 11 or 55, wherein the expression level determines the cancer status of the subject with at least 40% specificity. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a thyroid cancer. In some embodiments, the probe set further comprises a probe capable of detecting an expression level of at least one coding target. In some embodiments, the coding target is an exonic sequence. In some embodiments, the probe set further comprises a probe capable of detecting an expression level of at least one non-coding target. In some embodiments, the non-coding target is an intronic sequence or partially overlaps with an intronic sequence. In some embodiments, the non-coding target is a UTR sequence or partially overlaps with a UTR sequence. In some embodiments, assessing the cancer status includes assessing cancer recurrence risk. In some embodiments, assessing the cancer status includes determining a treatment modality. In some embodiments, assessing the cancer status includes determining the efficacy of treatment. In some embodiments, the target is a nucleic acid sequence. In some embodiments, the nucleic acid sequence is a DNA sequence. In some embodiments, the nucleic acid sequence is an RNA sequence. In some embodiments, the probes are between about 15 nucleotides and about 500 nucleotides in length. In some embodiments, the probes are between about 15 nucleotides and about 450 nucleotides in length. In some embodiments, the probes are between about 15 nucleotides and about 400 nucleotides in length. In some embodiments, the probes are between about 15 nucleotides and about 350 nucleotides in length. In some embodiments, the probes are between about 15 nucleotides and about 300 nucleotides in length. In some embodiments, the probes are between about 15 nucleotides and about 250 nucleotides in length. In some embodiments, the probes are between about 15 nucleotides and about 200 nucleotides in length. In some embodiments, the probes are at least 15 nucleotides in length. In some embodiments, the probes are at least 25 nucleotides in length. In some embodiments, the expression level determines the cancer status of the subject with at least 50% specificity. In some embodiments, the expression level determines the cancer status of the subject with at least 60% specificity. In some embodiments, the expression level determines the cancer status of the subject with at least 65% specificity. In some embodiments, the expression level determines the cancer status of the subject with at least 70% specificity. In some embodiments, the expression level determines the cancer status of the subject with at least 75% specificity. In some embodiments, the expression level determines the cancer status of the subject with at least 80% specificity. In some embodiments, the expression level determines the cancer status of the subject with at least 85% specificity. In some embodiments, the non-coding target is a non-coding RNA transcript and the non-coding RNA transcript is non-polyadenylated.

Further disclosed herein in some embodiments is a system for analyzing a cancer, comprising: (a) a probe set comprising a plurality of target sequences, wherein (i) the plurality of target sequences hybridizes to one or more targets selected from Tables 2 or 4; or (ii) the plurality of target sequences comprises one or more target sequences selected from Table 11; and (b) a computer model or algorithm for analyzing an expression level and/or expression profile of the target hybridized to the probe in a sample from a subject suffering from a cancer. In some embodiments, the system further comprises an electronic memory for capturing and storing an expression profile. In some embodiments, the system further comprises a computer-processing device, optionally connected to a computer network. In some embodiments, the system further comprises a software module executed by the computer-processing device to analyze an expression profile. In some embodiments, the system further comprises a software module executed by the computer-processing device to compare the expression profile to a standard or control. In some embodiments, the system further comprises a software module executed by the computer-processing device to determine the expression level of the target. In some embodiments, the system further comprises a machine to isolate the target or the probe from the sample. In some embodiments, the system further comprises a machine to sequence the target or the probe. In some embodiments, the system further comprises a machine to amplify the target or the probe. In some embodiments, the system further comprises a label that specifically binds to the target, the probe, or a combination thereof. In some embodiments, the system further comprises a software module executed by the computer-processing device to transmit an analysis of the expression profile to the individual or a medical professional treating the individual. In some embodiments, the system further comprises a software module executed by the computer-processing device to transmit a diagnosis or prognosis to the individual or a medical professional treating the individual. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the system further comprises a sequence for sequencing the plurality of targets. In some embodiments, the system further comprises an instrument for amplifying the plurality of targets. In some embodiments, the system further comprises a label for labeling the plurality of targets.

Further disclosed herein in some embodiments is a method of analyzing a cancer in an individual in need thereof, comprising: (a) obtaining an expression profile from a sample obtained from the individual, wherein the expression profile comprises one or more targets selected from Tables 2, 4, 11 or 55; and (b) comparing the expression profile from the sample to an expression profile of a control or standard. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer. In some embodiments, the method further comprises a software module executed by a computer-processing device to compare the expression profiles. In some embodiments, the method further comprises providing diagnostic or prognostic information to the individual about the cardiovascular disorder based on the comparison. In some embodiments, the method further comprises diagnosing the individual with a cancer if the expression profile of the sample (a) deviates from the control or standard from a healthy individual or population of healthy individuals, or (b) matches the control or standard from an individual or population of individuals who have or have had the cancer. In some embodiments, the method further comprises predicting the susceptibility of the individual for developing a cancer based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the method further comprises prescribing a treatment regimen based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the method further comprises altering a treatment regimen prescribed or administered to the individual based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the method further comprises predicting the individual's response to a treatment regimen based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the deviation is the expression level of one or more targets from the sample is greater than the expression level of one or more targets from a control or standard derived from a healthy individual or population of healthy individuals. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises quantifying the expression level of the plurality of targets. In some embodiments, the method further comprises labeling the plurality of targets. In some embodiments, assaying the expression level of a plurality of targets may comprise the use of a probe set. In some embodiments, obtaining the expression level may comprise the use of a classifier. The classifier may comprise a probe selection region (PSR). In some embodiments, the classifier may comprise the use of an algorithm. The algorithm may comprise a machine learning algorithm. In some embodiments, obtaining the expression level may also comprise sequencing the plurality of targets.

Disclosed herein in some embodiments is a method of diagnosing cancer in an individual in need thereof, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) diagnosing a cancer in the individual if the expression profile of the sample (i) deviates from the control or standard from a healthy individual or population of healthy individuals, or (ii) matches the control or standard from an individual or population of individuals who have or have had the cancer. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer. In some embodiments, the method further comprises a software module executed by a computer-processing device to compare the expression profiles. In some embodiments, the deviation is the expression level of one or more targets from the sample is greater than the expression level of one or more targets from a control or standard derived from a healthy individual or population of healthy individuals. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises quantifying the expression level of the plurality of targets. In some embodiments, the method further comprises labeling the plurality of targets. In some embodiments, obtaining the expression level may comprise the use of a classifier. The classifier may comprise a probe selection region (PSR). In some embodiments, the classifier may comprise the use of an algorithm. The algorithm may comprise a machine learning algorithm. In some embodiments, obtaining the expression level may also comprise sequencing the plurality of targets.

Further disclosed herein in some embodiments is a method of predicting whether an individual is susceptible to developing a cancer, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) predicting the susceptibility of the individual for developing a cancer based on (i) the deviation of the expression profile of the sample from a control or standard derived from a healthy individual or population of healthy individuals, or (ii) the similarity of the expression profiles of the sample and a control or standard derived from an individual or population of individuals who have or have had the cancer. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer. In some embodiments, the method further comprises a software module executed by a computer-processing device to compare the expression profiles. In some embodiments, the deviation is the expression level of one or more targets from the sample is greater than the expression level of one or more targets from a control or standard derived from a healthy individual or population of healthy individuals. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, obtaining the expression level may comprise the use of a classifier. The classifier may comprise a probe selection region (PSR). In some embodiments, the classifier may comprise the use of an algorithm. The algorithm may comprise a machine learning algorithm. In some embodiments, obtaining the expression level may also comprise sequencing the plurality of targets. In some embodiments, obtaining the expression level may also comprise amplifying the plurality of targets. In some embodiments, obtaining the expression level may also comprise quantifying the plurality of targets.

Further disclosed herein in some embodiments is a method of predicting an individual's response to a treatment regimen for a cancer, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) predicting the individual's response to a treatment regimen based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer. In some embodiments, the method further comprises a software module executed by a computer-processing device to compare the expression profiles. In some embodiments, the deviation is the expression level of one or more targets from the sample is greater than the expression level of one or more targets from a control or standard derived from a healthy individual or population of healthy individuals. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises quantifying the target, the probe, or any combination thereof. In some embodiments, the method further comprises labeling the target, the probe, or any combination thereof. In some embodiments, obtaining the expression level may comprise the use of a classifier. The classifier may comprise a probe selection region (PSR). In some embodiments, the classifier may comprise the use of an algorithm. The algorithm may comprise a machine learning algorithm. In some embodiments, obtaining the expression level may also comprise sequencing the plurality of targets. In some embodiments, obtaining the expression level may also comprise amplifying the plurality of targets. In some embodiments, obtaining the expression level may also comprise quantifying the plurality of targets.

Disclosed herein in some embodiments is a method of prescribing a treatment regimen for a cancer to an individual in need thereof, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) prescribing a treatment regimen based on (i) the deviation of the expression profile of the sample from a control or standard derived from a healthy individual or population of healthy individuals, or (ii) the similarity of the expression profiles of the sample and a control or standard derived from an individual or population of individuals who have or have had the cancer. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the plurality of targets comprises at least 30 targets selected from Tables 2, 11 or 55. In some embodiments, the plurality of targets comprises at least 35 targets selected from Tables 2, 11 or 55. In some embodiments, the plurality of targets comprises at least 40 targets selected from Tables 2, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer. In some embodiments, the method further comprises a software module executed by a computer-processing device to compare the expression profiles. In some embodiments, the deviation is the expression level of one or more targets from the sample is greater than the expression level of one or more targets from a control or standard derived from a healthy individual or population of healthy individuals. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises converting the expression levels of the target sequences into a likelihood score that indicates the probability that a biological sample is from a patient who will exhibit no evidence of disease, who will exhibit systemic cancer, or who will exhibit biochemical recurrence. In some embodiments, the method further comprises quantifying the expression level of the plurality of targets. In some embodiments, the method further comprises labeling the plurality of targets. In some embodiments, the target sequences are differentially expressed the cancer. In some embodiments, the differential expression is dependent on aggressiveness. In some embodiments, the expression profile is determined by a method selected from the group consisting of RT-PCR, Northern blotting, ligase chain reaction, array hybridization, and a combination thereof. In some embodiments, obtaining the expression level may comprise the use of a classifier. The classifier may comprise a probe selection region (PSR). In some embodiments, the classifier may comprise the use of an algorithm. The algorithm may comprise a machine learning algorithm. In some embodiments, obtaining the expression level may also comprise sequencing the plurality of targets. In some embodiments, obtaining the expression level may also comprise amplifying the plurality of targets. In some embodiments, obtaining the expression level may also comprise quantifying the plurality of targets.

Further disclosed herein is a classifier for analyzing a cancer, wherein the classifier has an AUC value of at least about 0.60. The AUC of the classifier may be at least about 0.60, 0.61, 0.62, 0.63, 0.64, 0.65, 0.66, 0.67, 0.68, 0.69, 0.70 or more. The AUC of the classifier may be at least about 0.71, 0.72, 0.73, 0.74, 0.75, 0.76, 0.77, 0.78, 0.79, 0.80 or more. The AUC of the classifier may be at least about 0.81, 0.82, 0.83, 0.84, 0.85, 0.86, 0.87, 0.88, 0.89, 0.90 or more. The AUC of the classifier may be at least about 0.91, 0.92, 0.93, 0.94, 0.95, 0.96, 0.97, 0.98, 0.99 or more. The 95% CI of a classifier or biomarker may be between about 1.10 to 1.70. In some instances, the difference in the range of the 95% CI for a biomarker or classifier is between about 0.25 to about 0.50, between about 0.27 to about 0.47, or between about 0.30 to about 0.45.

Further disclosed herein is a method for analyzing a cancer, comprising use of one or more classifiers, wherein the significance of the one or more classifiers is based on one or more metrics selected from the group comprising AUC, AUC P-value (Auc.pvalue), Wilcoxon Test P-value, Median Fold Difference (MFD), Kaplan Meier (KM) curves, survival AUC (survAUC), Kaplan Meier P-value (KM P-value), Univariable Analysis Odds Ratio P-value (uvaORPval), multivariable analysis Odds Ratio P-value (mvaORPval), Univariable Analysis Hazard Ratio P-value (uvaHRPval) and Multivariable Analysis Hazard Ratio P-value (mvaHRPval). The significance of the one or more classifiers may be based on two or more metrics selected from the group comprising AUC, AUC P-value (Auc.pvalue), Wilcoxon Test P-value, Median Fold Difference (MFD), Kaplan Meier (KM) curves, survival AUC (survAUC), Univariable Analysis Odds Ratio P-value (uvaORPval), multivariable analysis Odds Ratio P-value (mvaORPval), Kaplan Meier P-value (KM P-value), Univariable Analysis Hazard Ratio P-value (uvaHRPval) and Multivariable Analysis Hazard Ratio P-value (mvaHRPval). The significance of the one or more classifiers may be based on three or more metrics selected from the group comprising AUC, AUC P-value (Auc.pvalue), Wilcoxon Test P-value, Median Fold Difference (MFD), Kaplan Meier (KM) curves, survival AUC (survAUC), Kaplan Meier P-value (KM P-value), Univariable Analysis Odds Ratio P-value (uvaORPval), multivariable analysis Odds Ratio P-value (mvaORPval), Univariable Analysis Hazard Ratio P-value (uvaHRPval) and Multivariable Analysis Hazard Ratio P-value (mvaHRPval).

The one or more metrics may comprise AUC. The one or more metrics may comprise AUC and AUC P-value. The one or more metrics may comprise AUC P-value and Wilcoxon Test P-value. The one or more metrics may comprise Wilcoxon Test P-value. The one or more metrics may comprise AUC and Univariable Analysis Odds Ratio P-value (uvaORPval). The one or more metrics may comprise multivariable analysis Odds Ratio P-value (mvaORPval) and Multivariable Analysis Hazard Ratio P-value (mvaHRPval). The one or more metrics may comprise AUC and Multivariable Analysis Hazard Ratio P-value (mvaHRPval). The one or more metrics may comprise Wilcoxon Test P-value and Multivariable Analysis Hazard Ratio P-value (mvaHRPval).

The clinical significance of the classifier may be based on the AUC value. The AUC of the classifier may be at least about about 0.60, 0.61, 0.62, 0.63, 0.64, 0.65, 0.66, 0.67, 0.68, 0.69, 0.70 or more. The AUC of the classifier may be at least about 0.71, 0.72, 0.73, 0.74, 0.75, 0.76, 0.77, 0.78, 0.79, 0.80 or more. The AUC of the classifier may be at least about 0.81, 0.82, 0.83, 0.84, 0.85, 0.86, 0.87, 0.88, 0.89, 0.90 or more. The AUC of the classifier may be at least about 0.91, 0.92, 0.93, 0.94, 0.95, 0.96, 0.97, 0.98, 0.99 or more. The 95% CI of a classifier or biomarker may be between about 1.10 to 1.70. In some instances, the difference in the range of the 95% CI for a biomarker or classifier is between about 0.25 to about 0.50, between about 0.27 to about 0.47, or between about 0.30 to about 0.45.

The clinical significance of the classifier may be based on Univariable Analysis Odds Ratio P-value (uvaORPval). The Univariable Analysis Odds Ratio P-value (uvaORPval) of the classifier may be between about 0-0.4. The Univariable Analysis Odds Ratio P-value (uvaORPval) of the classifier may be between about 0-0.3. The Univariable Analysis Odds Ratio P-value (uvaORPval) of the classifier may be between about 0-0.2. The Univariable Analysis Odds Ratio P-value (uvaORPval) of the classifier may be less than or equal to 0.25, 0.22, 0.21, 0.20, 0.19, 0.18, 0.17, 0.16, 0.15, 0.14, 0.13, 0.12, 0.11. The Univariable Analysis Odds Ratio P-value (uvaORPval) of the classifier may be less than or equal to 0.10, 0.09, 0.08, 0.07, 0.06, 0.05, 0.04, 0.03, 0.02, 0.01. The Univariable Analysis Odds Ratio P-value (uvaORPval) of the classifier may be less than or equal to 0.009, 0.008, 0.007, 0.006, 0.005, 0.004, 0.003, 0.002, 0.001.

The clinical significance of the classifier may be based on multivariable analysis Odds Ratio P-value (mvaORPval). The multivariable analysis Odds Ratio P-value (mvaORPval) of the classifier may be between about 0-1. The multivariable analysis Odds Ratio P-value (mvaORPval) of the classifier may be between about 0-0.9. The multivariable analysis Odds Ratio P-value (mvaORPval) of the classifier may be between about 0-0.8. The multivariable analysis Odds Ratio P-value (mvaORPval) of the classifier may be less than or equal to 0.90, 0.88, 0.86, 0.84, 0.82, 0.80. The multivariable analysis Odds Ratio P-value (mvaORPval) of the classifier may be less than or equal to 0.78, 0.76, 0.74, 0.72, 0.70, 0.68, 0.66, 0.64, 0.62, 0.60, 0.58, 0.56, 0.54, 0.52, 0.50. The multivariable analysis Odds Ratio P-value (mvaORPval) of the classifier may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The multivariable analysis Odds Ratio P-value (mvaORPval) of the classifier may be less than or equal to 0.10, 0.09, 0.08, 0.07, 0.06, 0.05, 0.04, 0.03, 0.02, 0.01. The multivariable analysis Odds Ratio P-value (mvaORPval) of the classifier may be less than or equal to 0.009, 0.008, 0.007, 0.006, 0.005, 0.004, 0.003, 0.002, 0.001.

The clinical significance of the classifier may be based on the Kaplan Meier P-value (KM P-value). The Kaplan Meier P-value (KM P-value) of the classifier may be between about 0-0.8. The Kaplan Meier P-value (KM P-value) of the classifier may be between about 0-0.7. The Kaplan Meier P-value (KM P-value) of the classifier may be less than or equal to 0.80, 0.78, 0.76, 0.74, 0.72, 0.70, 0.68, 0.66, 0.64, 0.62, 0.60, 0.58, 0.56, 0.54, 0.52, 0.50. The Kaplan Meier P-value (KM P-value) of the classifier may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The Kaplan Meier P-value (KM P-value) of the classifier may be less than or equal to 0.10, 0.09, 0.08, 0.07, 0.06, 0.05, 0.04, 0.03, 0.02, 0.01. The Kaplan Meier P-value (KM P-value) of the classifier may be less than or equal to 0.009, 0.008, 0.007, 0.006, 0.005, 0.004, 0.003, 0.002, 0.001.

The clinical significance of the classifier may be based on the survival AUC value (survAUC). The survival AUC value (survAUC) of the classifier may be between about 0-1. The survival AUC value (survAUC) of the classifier may be between about 0-0.9. The survival AUC value (survAUC) of the classifier may be less than or equal to 1, 0.98, 0.96, 0.94, 0.92, 0.90, 0.88, 0.86, 0.84, 0.82, 0.80. The survival AUC value (survAUC) of the classifier may be less than or equal to 0.80, 0.78, 0.76, 0.74, 0.72, 0.70, 0.68, 0.66, 0.64, 0.62, 0.60, 0.58, 0.56, 0.54, 0.52, 0.50. The survival AUC value (survAUC) of the classifier may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The survival AUC value (survAUC) of the classifier may be less than or equal to 0.10, 0.09, 0.08, 0.07, 0.06, 0.05, 0.04, 0.03, 0.02, 0.01. The survival AUC value (survAUC) of the classifier may be less than or equal to 0.009, 0.008, 0.007, 0.006, 0.005, 0.004, 0.003, 0.002, 0.001.

The clinical significance of the classifier may be based on the Univariable Analysis Hazard Ratio P-value (uvaHRPval). The Univariable Analysis Hazard Ratio P-value (uvaHRPval) of the classifier may be between about 0-0.4. The Univariable Analysis Hazard Ratio P-value (uvaHRPval) of the classifier may be between about 0-0.3. The Univariable Analysis Hazard Ratio P-value (uvaHRPval) of the classifier may be less than or equal to 0.40, 0.38, 0.36, 0.34, 0.32. The Univariable Analysis Hazard Ratio P-value (uvaHRPval) of the classifier may be less than or equal to 0.30, 0.29, 0.28, 0.27, 0.26, 0.25, 0.24, 0.23, 0.22, 0.21, 0.20. The Univariable Analysis Hazard Ratio P-value (uvaHRPval) of the classifier may be less than or equal to 0.19, 0.18, 0.17, 0.16, 0.15, 0.14, 0.13, 0.12, 0.11. The Univariable Analysis Hazard Ratio P-value (uvaHRPval) of the classifier may be less than or equal to 0.10, 0.09, 0.08, 0.07, 0.06, 0.05, 0.04, 0.03, 0.02, 0.01. The Univariable Analysis Hazard Ratio P-value (uvaHRPval) of the classifier may be less than or equal to 0.009, 0.008, 0.007, 0.006, 0.005, 0.004, 0.003, 0.002, 0.001.

The clinical significance of the classifier may be based on the Multivariable Analysis Hazard Ratio P-value (mvaHRPval)mva HRPval. The Multivariable Analysis Hazard Ratio P-value (mvaHRPval)mva HRPval of the classifier may be between about 0-1. The Multivariable Analysis Hazard Ratio P-value (mvaHRPval)mva HRPval of the classifier may be between about 0-0.9. The Multivariable Analysis Hazard Ratio P-value (mvaHRPval)mva HRPval of the classifier may be less than or equal to 1, 0.98, 0.96, 0.94, 0.92, 0.90, 0.88, 0.86, 0.84, 0.82, 0.80. The Multivariable Analysis Hazard Ratio P-value (mvaHRPval)mva HRPval of the classifier may be less than or equal to 0.80, 0.78, 0.76, 0.74, 0.72, 0.70, 0.68, 0.66, 0.64, 0.62, 0.60, 0.58, 0.56, 0.54, 0.52, 0.50. The Multivariable Analysis Hazard Ratio P-value (mvaHRPval)mva HRPval of the classifier may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The Multivariable Analysis Hazard Ratio P-value (mvaHRPval) mva HRPval of the classifier may be less than or equal to 0.10, 0.09, 0.08, 0.07, 0.06, 0.05, 0.04, 0.03, 0.02, 0.01. The Multivariable Analysis Hazard Ratio P-value (mvaHRPval) mva HRPval of the classifier may be less than or equal to 0.009, 0.008, 0.007, 0.006, 0.005, 0.004, 0.003, 0.002, 0.001.

The clinical significance of the classifier may be based on the Multivariable Analysis Hazard Ratio P-value (mvaHRPval). The Multivariable Analysis Hazard Ratio P-value (mvaHRPval) of the classifier may be between about 0 to about 0.60. significance of the classifier may be based on the Multivariable Analysis Hazard Ratio P-value (mvaHRPval). The Multivariable Analysis Hazard Ratio P-value (mvaHRPval) of the classifier may be between about 0 to about 0.50. significance of the classifier may be based on the Multivariable Analysis Hazard Ratio P-value (mvaHRPval). The Multivariable Analysis Hazard Ratio P-value (mvaHRPval) of the classifier may be less than or equal to 0.50, 0.47, 0.45, 0.43, 0.40, 0.38, 0.35, 0.33, 0.30, 0.28, 0.25, 0.22, 0.20, 0.18, 0.16, 0.15, 0.14, 0.13, 0.12, 0.11, 0.10. The Multivariable Analysis Hazard Ratio P-value (mvaHRPval) of the classifier may be less than or equal to 0.10, 0.09, 0.08, 0.07, 0.06, 0.05, 0.04, 0.03, 0.02, 0.01. The Multivariable Analysis Hazard Ratio P-value (mvaHRPval) of the classifier may be less than or equal to 0.01, 0.009, 0.008, 0.007, 0.006, 0.005, 0.004, 0.003, 0.002, 0.001.

The method may further comprise determining an expression profile based on the one or more classifiers. The method may further comprise providing a sample from a subject. The subject may be a healthy subject. The subject may be suffering from a cancer or suspected of suffering from a cancer. The method may further comprise diagnosing a cancer in a subject based on the expression profile or classifier. The method may further comprise treating a cancer in a subject in need thereof based on the expression profile or classifier. The method may further comprise determining a treatment regimen for a cancer in a subject in need thereof based on the expression profile or classifier. The method may further comprise prognosing a cancer in a subject based on the expression profile or classifier.

Further disclosed herein is a kit for analyzing a cancer, comprising (a) a probe set comprising a plurality of target sequences, wherein the plurality of target sequences comprises at least one target sequence listed in Table 11; and (b) a computer model or algorithm for analyzing an expression level and/or expression profile of the target sequences in a sample. In some embodiments, the kit further comprises a computer model or algorithm for correlating the expression level or expression profile with disease state or outcome. In some embodiments, the kit further comprises a computer model or algorithm for designating a treatment modality for the individual. In some embodiments, the kit further comprises a computer model or algorithm for normalizing expression level or expression profile of the target sequences. In some embodiments, the kit further comprises a computer model or algorithm comprising a robust multi-chip average (RMA), probe logarithmic intensity error estimation (PLIER), non-linear fit (NLFIT) quantile-based, nonlinear normalization, or a combination thereof. In some embodiments, the plurality of target sequences comprises at least 5 target sequences selected from Table 11. In some embodiments, the plurality of target sequences comprises at least 10 target sequences selected from Table 11. In some embodiments, the plurality of target sequences comprises at least 15 target sequences selected from Table 11. In some embodiments, the plurality of target sequences comprises at least 20 target sequences selected from Table 11. In some embodiments, the plurality of target sequences comprises at least 30 target sequences selected from Table 11. In some embodiments, the plurality of target sequences comprises at least 35 target sequences selected from Table 11. In some embodiments, the plurality of targets comprises at least 40 target sequences selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer.

Further disclosed herein is a kit for analyzing a cancer, comprising (a) a probe set comprising a plurality of target sequences, wherein the plurality of target sequences hybridizes to one or more targets selected from Tables 2, 4, 11 or 55; and (b) a computer model or algorithm for analyzing an expression level and/or expression profile of the target sequences in a sample. In some embodiments, the kit further comprises a computer model or algorithm for correlating the expression level or expression profile with disease state or outcome. In some embodiments, the kit further comprises a computer model or algorithm for designating a treatment modality for the individual. In some embodiments, the kit further comprises a computer model or algorithm for normalizing expression level or expression profile of the target sequences. In some embodiments, the kit further comprises a computer model or algorithm comprising a robust multi-chip average (RMA), probe logarithmic intensity error estimation (PLIER), non-linear fit (NLFIT) quantile-based, nonlinear normalization, or a combination thereof. In some embodiments, the targets comprise at least 5 targets selected from Tables 2, 4, 11 or 55. In some embodiments, the targets comprise at least 10 targets selected from Tables 2, 4, 11 or 55. In some embodiments, the targets comprise at least 15 targets selected from Tables 2, 4, 11 or 55. In some embodiments, the targets comprise at least 20 targets selected from Tables 2, 4, 11 or 55. In some embodiments, the targets comprise at least 30 targets selected from Tables 2, 11 or 55. In some embodiments, the targets comprise at least 35 targets selected from Tables 2, 11 or 55. In some embodiments, the targets comprise comprises at least 40 targets selected from Tables 2, 11 or 55. In some embodiments, the targets are selected from Table 2. In some embodiments, the targets are selected from Table 4. In some embodiments, the targets are selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a breast cancer. In some embodiments, the cancer is a thyroid cancer. In some embodiments, the cancer is a lung cancer.

INCORPORATION BY REFERENCE

All publications, patents, and patent applications mentioned in this specification are herein incorporated by reference in their entireties to the same extent as if each individual publication, patent, or patent application was specifically and individually indicated to be incorporated by reference.

Figure 1:
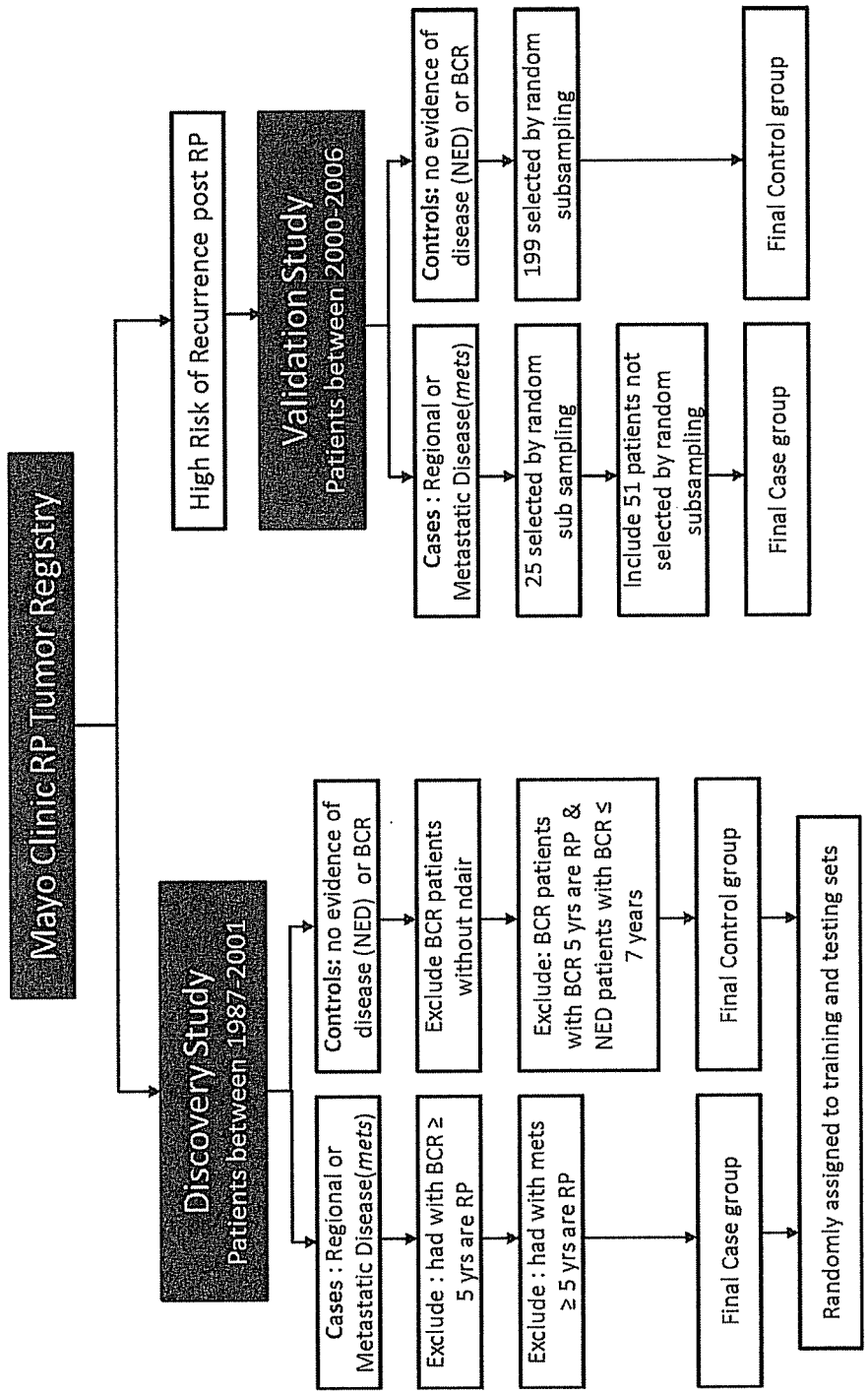
FIG. 1. Overview of the studies. CONSORT diagram illustrating the design for the training and independent validation studies.

Table 3. Gene Ontology Terms Enriched in the 43-Biomarker Signature

Table 4. 22-Biomarker Set. Chromosomal coordinates correspond to the hg19 version of the human genome.

Table 5. Comparison of Discrimination ability of classifiers in different datasets Table 6. Reclassification of GPSM categories by GC.

Table 7. Univariable Analysis for panel of prognostic classifiers and clinicopathologic variables (for METS)

Table 8. Multivariable Cox regression analysis.

Table 9. Multivariable Analysis for panel of prognostic classifiers and clinicopathologic variables Adjusted for Hormone Therapy (for METS)

Table 10. Multivariable Analysis of GC compared to GPSM and CC (for METS)

Table 11. List of Target Sequences

Table 12. Univariable and Multivariable Logistic Regression Analysis in Testing Set Table 13. Multivariable Cox proportional hazards modeling comparing genomic classifier (GC) to clinicopathologic variables using different Gleason Score parameterization in the independent validation set.

Table 14. Multivariable Cox proportional hazard models of GC with Stephenson Nomogram Table 15. Multivariable Cox proportional hazards modeling of decile risk groups of the genomic classifier (GC) after adjusting for treatment.

Table 16. Survival analysis of GC score risk groups (<0.4, 0.4-0.6, >0.6).

Table 17. Reclassification by GC of Gleason Risk categories among cases and controls in the testing set.

Table 18. Number of metastasis and PCSM events for different GC score risk groups among pathologic GS categories in the independent validation set.

Table 19. Number of patients at risk of developing PCSM at various time points after BCR Table 20. Number of patients at risk of metastasis at various time points after BCR Table 21. Clinical characteristics of the cohort in Example 9.

Table 22. Survival ROC AUCs and associated 95% confidence intervals for GC, CAPRA-S and other individual clinical variables.

Table 23. Reclassification of GC low risk (GC Score<0.4) and GC high risk (GC Score≥0.4) for CAPRA-S low, intermediate and high risk scores.

Table 24. Univariable and Multivariable Analysis for GC, CAPRA-S and individual clinical variables.

Table 25. Characteristics of urologists participating in study.

Table 26. Characteristics of patient cases.

Table 27. Probability of Changing Treatment Recommendation from Pre to Post GC test Table 28. Change in treatment intensity by initial Perceived and GC risks.

Table 29. Detailed Overview of Probability of Changing Treatment Recommendation from Pre to Post GC test.

Table 30. Proportions of patients with treatment recommended.

Table 31. Urologist reported confidence in and influence on treatment recommendations.

Table 32. Breakdown of treatment recommendations pre and post-GC for Low and High GC Risk groups in the Adjuvant setting Table 33. Clinical and pathologic characteristics of patient cohort.

Table 34. Number of patients at risk of developing metastasis at various time points after BCR.

Table 35. Number of patients at risk of developing metastasis at various time points after BCR.

Table 36. Number of patients at risk of developing metastasis at various time points after BCR.

Table 37. Survival Analysis for GC and clinicopathologic factors. Multivariable analysis is adjusted for adjuvant treatment, GC reported for 10% unit increase.

Table 38. Survival Analysis for GC, Stephenson and CAPRA-S. Multivariable analyses are adjusted for adjuvant treatment, GC and Stephenson reported for 10% unit increase.

Table 39: biomarkers from the 43 biomarker panel with significance for Wilcoxon P-value (auc.pvalue) and other metrics for the BCR event endpoint.

Table 40: biomarkers from the 43 biomarker panel with significance for Wilcoxon P-value (auc.pvalue) and other metrics for the ECE endpoint.

Table 41: biomarkers from the 43 biomarker panel with significance for Wilcoxon P-value (auc.pvalue) and other metrics for the LCR event endpoint.

Table 42: biomarkers from the 43 biomarker panel with significance for Wilcoxon P-value (auc.pvalue) and other metrics for the LNI endpoint.

Table 43: biomarkers from the 43 biomarker panel with significance for Wilcoxon P-value (auc.pvalue) and other metrics for the MET event endpoint.

Table 44: biomarkers from the 43 biomarker panel with significance for Wilcoxon P-value (auc.pvalue) and other metrics for the OS event endpoint.

Table 45: biomarkers from the 43 biomarker panel with significance for Wilcoxon P-value (auc.pvalue) and other metrics for the pathological Gleason endpoint.

Table 46: biomarkers from the 43 biomarker panel with significance for Wilcoxon P-value (auc.pvalue) and other metrics for the PCSM event endpoint.

Table 47: biomarkers from the 43 biomarker panel with significance for Wilcoxon P-value (auc.pvalue) and other metrics for the psaDT endpoint.

Table 48: biomarkers from the 43 biomarker panel with significance for Wilcoxon P-value (auc.pvalue) and other metrics for the SVI endpoint.

Table 49: pairwise biomarkers from the 43 biomarker panel with significance for Wilcoxon P-value (auc.pvalue<=0.05) and other metrics for the BCR event endpoint.

Table 50: pairwise biomarkers from the 43 biomarker panel with significance for Wilcoxon P-value (auc.pvalue<=0.001) and other metrics for the MET event endpoint.

Table 51: pairwise biomarkers from the 43 biomarker panel with significance for Wilcoxon P-value (auc.pvalue<=0.05) and other metrics for the PCSM event endpoint.

Table 52: pairwise biomarkers from the 43 biomarker panel with significance for Wilcoxon P-value (auc.pvalue<=0.05) and other metrics for the psaDT endpoint.

Table 53: biomarkers from the 2,040 biomarker library with significance for Wilcoxon P-value (auc.pvalue<=0.05) and other metrics for the BCR event endpoint.

Table 54: biomarkers from the 2,040 biomarker library with significance for Wilcoxon P-value (auc.pvalue<=0.05) and other metrics for the MET event endpoint.

Table 55: 2,040 biomarker library. For each feature, genomic category, associated Affymetrix probeset ID, Associated Gene, Kolmogorov Smirnov Test P-value demonstrating statistical significance at 0.05 level is shown, together with Mean Decrease in Gini and Mean Decrease in Accuracy.

DETAILED DESCRIPTION OF THE INVENTION

The present invention discloses systems and methods for diagnosing, predicting, and/or monitoring the status or outcome of a cancer in a subject using expression-based analysis of a plurality of targets. Generally, the method comprises (a) optionally providing a sample from a subject suffering from a cancer; (b) assaying the expression level for a plurality of targets in the sample; and (c) diagnosing, predicting and/or monitoring the status or outcome of the cancer based on the expression level of the plurality of targets.

Assaying the expression level for a plurality of targets in the sample may comprise applying the sample to a microarray. In some instances, assaying the expression level may comprise the use of an algorithm. The algorithm may be used to produce a classifier. Alternatively, the classifier may comprise a probe selection region. In some instances, assaying the expression level for a plurality of targets comprises detecting and/or quantifying the plurality of targets. In some embodiments, assaying the expression level for a plurality of targets comprises sequencing the plurality of targets. In some embodiments, assaying the expression level for a plurality of targets comprises amplifying the plurality of targets. In some embodiments, assaying the expression level for a plurality of targets comprises quantifying the plurality of targets. In some embodiments, assaying the expression level for a plurality of targets comprises conducting a multiplexed reaction on the plurality of targets.

In some instances, the plurality of targets comprises one or more targets selected from Tables 2, 4, 11 or 55. In some instances, the plurality of targets comprises at least about 2, at least about 3, at least about 4, at least about 5, at least about 6, at least about 7, at least about 8, at least about 9, or at least about 10 targets selected from Table 2, 4, and 11. In other instances, the plurality of targets comprises at least about 12, at least about 15, at least about 17, at least about 20, at least about 22, at least about 25, at least about 27, at least about 30, at least about 32, at least about 35, at least about 37, or at least about 40 targets selected from Tables 2, 4, 11 or 55. In some instances, the targets are selected from Table 2. In some instances, the targets are selected from Table 4. In some instances, the targets are selected from Table 11. In some instances, the plurality of targets comprises a coding target, non-coding target, or any combination thereof. In some instances, the coding target comprises an exonic sequence. In other instances, the non-coding target comprises a non-exonic sequence. In some instances, the non-exonic sequence comprises an untranslated region (e.g., UTR), intronic region, intergenic region, or any combination thereof. Alternatively, the plurality of targets comprises an anti-sense sequence. In other instances, the plurality of targets comprises a non-coding RNA transcript.

Further disclosed herein, is a probe set for diagnosing, predicting, and/or monitoring a cancer in a subject. In some instances, the probe set comprises a plurality of probes capable of detecting an expression level of one or more targets selected from Tables 2, 4, 11 or 55, wherein the expression level determines the cancer status of the subject with at least about 45% specificity. In some instances, detecting an expression level comprise detecting gene expression, protein expression, or any combination thereof. In some instances, the plurality of targets comprises one or more targets selected from Tables 2, 4, 11 or 55. In some instances, the plurality of targets comprises at least about 2, at least about 3, at least about 4, at least about 5, at least about 6, at least about 7, at least about 8, at least about 9, or at least about 10 targets selected from Table 2, 4, and 11. In other instances, the plurality of targets comprises at least about 12, at least about 15, at least about 17, at least about 20, at least about 22, at least about 25, at least about 27, at least about 30, at least about 32, at least about 35, at least about 37, or at least about 40 targets selected from Tables 2, 4, 11 or 55. In some instances, the targets are selected from Table 2. In some instances, the targets are selected from Table 4. In some instances, the targets are selected from Table 11. In some instances, the plurality of targets comprises a coding target, non-coding target, or any combination thereof. In some instances, the coding target comprises an exonic sequence. In other instances, the non-coding target comprises a non-exonic sequence. In some instances, the non-exonic sequence comprises an untranslated region (e.g., UTR), intronic region, intergenic region, or any combination thereof. Alternatively, the plurality of targets comprises an anti-sense sequence. In other instances, the plurality of targets comprises a non-coding RNA transcript.

Further disclosed herein are methods for characterizing a patient population. Generally, the method comprises: (a) providing a sample from a subject; (b) assaying the expression level for a plurality of targets in the sample; and (c) characterizing the subject based on the expression level of the plurality of targets. In some instances, the plurality of targets comprises one or more targets selected from Tables 2, 4, 11 or 55. In some instances, the plurality of targets comprises at least about 2, at least about 3, at least about 4, at least about 5, at least about 6, at least about 7, at least about 8, at least about 9, or at least about 10 targets selected from Tables 2, 4, 11 or 55. In other instances, the plurality of targets comprises at least about 12, at least about 15, at least about 17, at least about 20, at least about 22, at least about 25, at least about 27, at least about 30, at least about 32, at least about 35, at least about 37, or at least about 40 targets selected from Tables 2, 4, 11 or 55. In some instances, the targets are selected from Table 2. In some instances, the targets are selected from Table 4. In some instances, the targets are selected from Table 11. In some instances, the plurality of targets comprises a coding target, non-coding target, or any combination thereof. In some instances, the coding target comprises an exonic sequence. In other instances, the non-coding target comprises a non-exonic sequence. In some instances, the non-exonic sequence comprises an untranslated region (e.g., UTR), intronic region, intergenic region, or any combination thereof. Alternatively, the plurality of targets comprises an anti-sense sequence. In other instances, the plurality of targets comprises a non-coding RNA transcript.

In some instances, characterizing the subject comprises determining whether the subject would respond to an anti-cancer therapy. Alternatively, characterizing the subject comprises identifying the subject as a non-responder to an anti-cancer therapy. Optionally, characterizing the subject comprises identifying the subject as a responder to an anti-cancer therapy.

Before the present invention is described in further detail, it is to be understood that this invention is not limited to the particular methodology, compositions, articles or machines described, as such methods, compositions, articles or machines can, of course, vary. It is also to be understood that the terminology used herein is for the purpose of describing particular embodiments only, and is not intended to limit the scope of the present invention.

Definitions

Unless defined otherwise or the context clearly dictates otherwise, all technical and scientific terms used herein have the same meaning as commonly understood by one of ordinary skill in the art to which this invention belongs. In describing the present invention, the following terms may be employed, and are intended to be defined as indicated below.

The term "polynucleotide" as used herein refers to a polymer of greater than one nucleotide in length of ribonucleic acid (RNA), deoxyribonucleic acid (DNA), hybrid RNA/DNA, modified RNA or DNA, or RNA or DNA mimetics, including peptide nucleic acids (PNAs). The polynucleotides may be single- or double-stranded. The term includes polynucleotides composed of naturally-occurring nucleobases, sugars and covalent internucleoside (backbone) linkages as well as polynucleotides having non-naturally-occurring portions which function similarly. Such modified or substituted polynucleotides are well known in the art and for the purposes of the present invention, are referred to as "analogues."

"Complementary" or "substantially complementary" refers to the ability to hybridize or base pair between nucleotides or nucleic acids, such as, for instance, between a sensor peptide nucleic acid or polynucleotide and a target polynucleotide. Complementary nucleotides are, generally, A and T (or A and U), or C and G. Two single-stranded polynucleotides or PNAs are said to be substantially complementary when the bases of one strand, optimally aligned and compared and with appropriate insertions or deletions, pair with at least about 80% of the bases of the other strand, usually at least about 90% to 95%, and more preferably from about 98 to 100%.

Alternatively, substantial complementarity exists when a polynucleotide may hybridize under selective hybridization conditions to its complement. Typically, selective hybridization may occur when there is at least about 65% complementarity over a stretch of at least 14 to 25 bases, for example at least about 75%, or at least about 90% complementarity.

"Preferential binding" or "preferential hybridization" refers to the increased propensity of one polynucleotide to bind to its complement in a sample as compared to a noncomplementary polymer in the sample.

Hybridization conditions may typically include salt concentrations of less than about 1M, more usually less than about 500 mM, for example less than about 200 mM. In the case of hybridization between a peptide nucleic acid and a polynucleotide, the hybridization can be done in solutions containing little or no salt. Hybridization temperatures can be as low as 5° C., but are typically greater than 22° C., and more typically greater than about 30° C., for example in excess of about 37° C. Longer fragments may require higher hybridization temperatures for specific hybridization as is known in the art. Other factors may affect the stringency of hybridization, including base composition and length of the complementary strands, presence of organic solvents and extent of base mismatching, and the combination of parameters used is more important than the absolute measure of any one alone. Other hybridization conditions which may be controlled include buffer type and concentration, solution pH, presence and concentration of blocking reagents to decrease background binding such as repeat sequences or blocking protein solutions, detergent type(s) and concentrations, molecules such as polymers which increase the relative concentration of the polynucleotides, metal ion(s) and their concentration(s), chelator(s) and their concentrations, and other conditions known in the art.

"Multiplexing" herein refers to an assay or other analytical method in which multiple analytes are assayed. In some instances, the multiple analytes are from the same sample. In some instances, the multiple analytes are assayed simultaneously. Alternatively, the multiple analytes are assayed sequentially. In some instances, assaying the multiple analytes occurs in the same reaction volume. Alternatively, assaying the multiple analytes occurs in separate or multiple reaction volumes.

A "target sequence" as used herein (also occasionally referred to as a "PSR" or "probe selection region") refers to a region of the genome against which one or more probes can be designed. A "target sequence" may be a coding target or a non-coding target. A "target sequence" may comprise exonic and/or non-exonic sequences. Alternatively, a "target sequence" may comprise an ultraconserved region. An ultraconserved region is generally a sequence that is at least 200 base pairs and is conserved across multiple species. An ultraconserved region may be exonic or non-exonic. Exonic sequences may comprise regions on a protein-coding gene, such as an exon, UTR, or a portion thereof. Non-exonic sequences may comprise regions on a protein-coding, non protein-coding gene, or a portion thereof. For example, non-exonic sequences may comprise intronic regions, promoter regions, intergenic regions, a non-coding transcript, an exon anti-sense region, an intronic anti-sense region, UTR anti-sense region, non-coding transcript anti-sense region, or a portion thereof.

As used herein, a probe is any polynucleotide capable of selectively hybridizing to a target sequence or its complement, or to an RNA version of either. A probe may comprise ribonucleotides, deoxyribonucleotides, peptide nucleic acids, and combinations thereof. A probe may optionally comprise one or more labels. In some embodiments, a probe may be used to amplify one or both strands of a target sequence or an RNA form thereof, acting as a sole primer in an amplification reaction or as a member of a set of primers.

As used herein, a non-coding target may comprise a nucleotide sequence. The nucleotide sequence is a DNA or RNA sequence. A non-coding target may include a UTR sequence, an intronic sequence, or a non-coding RNA transcript. A non-coding target also includes sequences which partially overlap with a UTR sequence or an intronic sequence. A non-coding target also includes non-exonic transcripts.

As used herein, a coding target includes nucleotide sequences that encode for a protein and peptide sequences. The nucleotide sequence is a DNA or RNA sequence. The coding target includes protein-coding sequence. Protein-coding sequences include exon-coding sequences (e.g., exonic sequences).

As used herein, diagnosis of cancer may include the identification of cancer in a subject, determining the malignancy of the cancer, or determining the stage of the cancer.

As used herein, prognosis of cancer may include predicting the clinical outcome of the patient, assessing the risk of cancer recurrence, determining treatment modality, or determining treatment efficacy.

"Having" is an open-ended phrase like "comprising" and "including," and includes circumstances where additional elements are included and circumstances where they are not "Optional" or "optionally" means that the subsequently described event or circumstance may or may not occur, and that the description includes instances where the event or circumstance occurs and instances in which it does not.

As used herein 'NED' describes a clinically distinct disease state in which patients show no evidence of disease (NED') at least 5 years after surgery, 'PSA' describes a clinically distinct disease state in which patients show biochemical relapse only (two successive increases in prostate-specific antigen levels but no other symptoms of disease with at least 5 years follow up after surgery; TSA') and 'SYS' describes a clinically distinct disease state in which patients develop biochemical relapse and present with systemic cancer disease or metastases ('SYS') within five years after the initial treatment with radical prostatectomy.

The terms "METS", "SYS", "systemic event", "Systemic progression", "CR" or "Clinical Recurrence" may be used interchangeably and generally refer to patients that experience BCR (biochemical reccurrence) and that develop metastases (confirmed by bone or CT scan). The patients may experience BCR within 5 years of RP (radial prostectomy). The patients may develop metastases within 5 years of BCR. In some cases, patients regarded as METS may experience BCR after 5 years of RP.

As used herein, the term "about" refers to approximately a +/−10% variation from a given value. It is to be understood that such a variation is always included in any given value provided herein, whether or not it is specifically referred to.

Use of the singular forms "a," "an," and "the" include plural references unless the context clearly dictates otherwise. Thus, for example, reference to "a polynucleotide" includes a plurality of polynucleotides, reference to "a target" includes a plurality of such targets, reference to "a normalization method" includes a plurality of such methods, and the like. Additionally, use of specific plural references, such as "two," "three," etc., read on larger numbers of the same subject, unless the context clearly dictates otherwise.

Terms such as "connected," "attached," "linked" and "conjugated" are used interchangeably herein and encompass direct as well as indirect connection, attachment, linkage or conjugation unless the context clearly dictates otherwise.

Where a range of values is recited, it is to be understood that each intervening integer value, and each fraction thereof, between the recited upper and lower limits of that range is also specifically disclosed, along with each sub-range between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values, which are about the same quantity or amount as the recited value, are also within the scope of the invention, as are ranges based thereon. Where a combination is disclosed, each sub-combination of the elements of that combination is also specifically disclosed and is within the scope of the invention. Conversely, where different elements or groups of elements are disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Coding and Non-Coding Targets

The methods disclosed herein often comprise assaying the expression level of a plurality of targets. The plurality of targets may comprise coding targets and/or non-coding targets of a protein-coding gene or a non protein-coding gene. A protein-coding gene structure may comprise an exon and an intron. The exon may further comprise a coding sequence (CDS) and an untranslated region (UTR). The protein-coding gene may be transcribed to produce a pre-mRNA and the pre-mRNA may be processed to produce a mature mRNA. The mature mRNA may be translated to produce a protein.

A non protein-coding gene structure may comprise an exon and intron. Usually, the exon region of a non protein-coding gene primarily contains a UTR. The non protein-coding gene may be transcribed to produce a pre-mRNA and the pre-mRNA may be processed to produce a non-coding RNA (ncRNA).

A coding target may comprise a coding sequence of an exon. A non-coding target may comprise a UTR sequence of an exon, intron sequence, intergenic sequence, promoter sequence, non-coding transcript, CDS antisense, intronic antisense, UTR antisense, or non-coding transcript antisense. A non-coding transcript may comprise a non-coding RNA (ncRNA).

In some instances, the plurality of targets may be differentially expressed. In some instances, a plurality of probe selection regions (PSRs) is differentially expressed.

In some instances, the plurality of targets comprises one or more targets selected from Tables 2, 4, 11 or 55. In some instances, the plurality of targets comprises at least about 2, at least about 3, at least about 4, at least about 5, at least about 6, at least about 7, at least about 8, at least about 9, or at least about 10 targets selected from Tables 2, 4, 11 or 55. In other instances, the plurality of targets comprises at least about 12, at least about 15, at least about 17, at least about 20, at least about 22, at least about 25, at least about 27, at least about 30, at least about 32, at least about 35, at least about 37, or at least about 40 targets selected from Tables 2, 4, 11 or 55. In some instances, the targets are selected from Table 2. In some instances, the targets are selected from Table 4. In some instances, the targets are selected from Table 11. In some instances, the plurality of targets comprises a coding target, non-coding target, or any combination thereof. In some instances, the coding target comprises an exonic sequence. In other instances, the non-coding target comprises a non-exonic sequence. Alternatively, a non-coding target comprises a UTR sequence, an intronic sequence, or a non-coding RNA transcript. In some instances, a non-coding target comprises sequences which partially overlap with a UTR sequence or an intronic sequence. A non-coding target also includes non-exonic transcripts. Exonic sequences may comprise regions on a protein-coding gene, such as an exon, UTR, or a portion thereof. Non-exonic sequences may comprise regions on a protein-coding, non protein-coding gene, or a portion thereof. For example, non-exonic sequences may comprise intronic regions, promoter regions, intergenic regions, a non-coding transcript, an exon anti-sense region, an intronic anti-sense region, UTR anti-sense region, non-coding transcript anti-sense region, or a portion thereof. In other instances, the plurality of targets comprises a non-coding RNA transcript.

In some instances, the plurality of targets is at least about 70% identical to a sequence selected from SEQ ID NOs 1-43. Alternatively, the plurality of targets is at least about 80% identical to a sequence selected from SEQ ID NOs 1-43. In some instances, the plurality of targets is at least about 85% identical to a sequence selected from SEQ ID NOs 1-43. In some instances, the plurality of targets is at least about 90% identical to a sequence selected from SEQ ID NOs 1-43. Alternatively, the plurality of targets is at least about 95% identical to a sequence selected from SEQ ID NOs 1-43.

Probes/Primers

The present invention provides for a probe set for diagnosing, monitoring and/or predicting a status or outcome of a cancer in a subject comprising a plurality of probes, wherein (i) the probes in the set are capable of detecting an expression level of at least one non-coding target; and (ii) the expression level determines the cancer status of the subject with at least about 40% specificity.

The probe set may comprise one or more polynucleotide probes. Individual polynucleotide probes comprise a nucleotide sequence derived from the nucleotide sequence of the target sequences or complementary sequences thereof. The nucleotide sequence of the polynucleotide probe is designed such that it corresponds to, or is complementary to the target sequences. The polynucleotide probe can specifically hybridize under either stringent or lowered stringency hybridization conditions to a region of the target sequences, to the complement thereof, or to a nucleic acid sequence (such as a cDNA) derived therefrom.

The selection of the polynucleotide probe sequences and determination of their uniqueness may be carried out in silico using techniques known in the art, for example, based on a BLASTN search of the polynucleotide sequence in question against gene sequence databases, such as the Human Genome Sequence, UniGene, dbEST or the non-redundant database at NCBI. In one embodiment of the invention, the polynucleotide probe is complementary to a region of a target mRNA derived from a target sequence in the probe set. Computer programs can also be employed to select probe sequences that may not cross hybridize or may not hybridize non-specifically.

In some instances, microarray hybridization of RNA, extracted from prostate cancer tissue samples and amplified, may yield a dataset that is then summarized and normalized by the fRMA technique. The 5,362,207 raw expression probes are summarized and normalized into 1,411,399 probe selection regions ("PSRs"). After removal (or filtration) of cross-hybridizing PSRs, highly variable PSRs (variance above the 90th percentile), and PSRs containing more than 4 probes, approximately 1.1 million PSRs remain. Following fRMA and filtration, the data can be decomposed into its principal components and an analysis of variance model is used to determine the extent to which a batch effect remains present in the first 10 principal components.

These remaining 1.1 million PSRs can then be subjected to filtration by a T-test between CR (clinical recurrence) and non-CR samples. Using a p-value cut-off of 0.01, 18,902 features remained in analysis for further selection. Feature selection was performed by regularized logistic regression using the elastic-net penalty. The regularized regression was bootstrapped over 1000 times using all training data; with each iteration of bootstrapping features that have non-zero co-efficient following 3-fold cross validation were tabulated. In some instances, features that were selected in at least 25% of the total runs were used for model building.

One skilled in the art understands that the nucleotide sequence of the polynucleotide probe need not be identical to its target sequence in order to specifically hybridize thereto. The polynucleotide probes of the present invention, therefore, comprise a nucleotide sequence that is at least about 65% identical to a region of the coding target or non-coding target selected from Tables 2, 4, 11 or 55. In another embodiment, the nucleotide sequence of the polynucleotide probe is at least about 70% identical a region of the coding target or non-coding target from Tables 2, 4, 11 and 55. In another embodiment, the nucleotide sequence of the polynucleotide probe is at least about 75% identical a region of the coding target or non-coding target from Tables 2, 4, 11 and 55. In another embodiment, the nucleotide sequence of the polynucleotide probe is at least about 80% identical a region of the coding target or non-coding target from Tables 2, 4, 11 and 55. In another embodiment, the nucleotide sequence of the polynucleotide probe is at least about 85% identical a region of the coding target or non-coding target from Tables 2, 4, 11 and 55. In another embodiment, the nucleotide sequence of the polynucleotide probe is at least about 90% identical a region of the coding target or non-coding target from Tables 2, 4, 11 and 55. In a further embodiment, the nucleotide sequence of the polynucleotide probe is at least about 95% identical to a region of the coding target or non-coding target from Tables 2, 4, 11 and 55. In some instances, the targets are selected from Table 2. In some instances, the targets are selected from Table 4. In some instances, the targets are selected from Table 11.

Methods of determining sequence identity are known in the art and can be determined, for example, by using the BLASTN program of the University of Wisconsin Computer Group (GCG) software or provided on the NCBI website. The nucleotide sequence of the polynucleotide probes of the present invention may exhibit variability by differing (e.g. by nucleotide substitution, including transition or transversion) at one, two, three, four or more nucleotides from the sequence of the coding target or non-coding target.

Other criteria known in the art may be employed in the design of the polynucleotide probes of the present invention. For example, the probes can be designed to have <50% G content and/or between about 25% and about 70% G+C content. Strategies to optimize probe hybridization to the target nucleic acid sequence can also be included in the process of probe selection.

Hybridization under particular pH, salt, and temperature conditions can be optimized by taking into account melting temperatures and by using empirical rules that correlate with desired hybridization behaviors. Computer models may be used for predicting the intensity and concentration-dependence of probe hybridization.

The polynucleotide probes of the present invention may range in length from about 15 nucleotides to the full length of the coding target or non-coding target. In one embodiment of the invention, the polynucleotide probes are at least about 15 nucleotides in length. In another embodiment, the polynucleotide probes are at least about 20 nucleotides in length. In a further embodiment, the polynucleotide probes are at least about 25 nucleotides in length. In another embodiment, the polynucleotide probes are between about 15 nucleotides and about 500 nucleotides in length. In other embodiments, the polynucleotide probes are between about 15 nucleotides and about 450 nucleotides, about 15 nucleotides and about 400 nucleotides, about 15 nucleotides and about 350 nucleotides, about 15 nucleotides and about 300 nucleotides, about 15 nucleotides and about 250 nucleotides, about 15 nucleotides and about 200 nucleotides in length. In some embodiments, the probes are at least 15 nucleotides in length. In some embodiments, the probes are at least 15 nucleotides in length. In some embodiments, the probes are at least 20 nucleotides, at least 25 nucleotides, at least 50 nucleotides, at least 75 nucleotides, at least 100 nucleotides, at least 125 nucleotides, at least 150 nucleotides, at least 200 nucleotides, at least 225 nucleotides, at least 250 nucleotides, at least 275 nucleotides, at least 300 nucleotides, at least 325 nucleotides, at least 350 nucleotides, at least 375 nucleotides in length.

The polynucleotide probes of a probe set can comprise RNA, DNA, RNA or DNA mimetics, or combinations thereof, and can be single-stranded or double-stranded. Thus the polynucleotide probes can be composed of naturally-occurring nucleobases, sugars and covalent internucleoside (backbone) linkages as well as polynucleotide probes having non-naturally-occurring portions which function similarly. Such modified or substituted polynucleotide probes may provide desirable properties such as, for example, enhanced affinity for a target gene and increased stability. The probe set may comprise a coding target and/or a non-coding target. Preferably, the probe set comprises a combination of a coding target and non-coding target.

In some embodiments, the probe set comprise a plurality of target sequences that hybridize to at least about 5 coding targets and/or non-coding targets selected from Tables 2, 4, 11 or 55. Alternatively, the probe set comprise a plurality of target sequences that hybridize to at least about 10 coding targets and/or non-coding targets selected from Tables 2, 4, 11 or 55. In some embodiments, the probe set comprise a plurality of target sequences that hybridize to at least about 15 coding targets and/or non-coding targets selected from Tables 2, 4, 11 or 55. In some embodiments, the probe set comprise a plurality of target sequences that hybridize to at least about 20 coding targets and/or non-coding targets selected from Tables 2, 4, 11 or 55. In some embodiments, the probe set comprise a plurality of target sequences that hybridize to at least about 30 coding targets and/or non-coding targets selected from Tables 2, 4, 11 or 55. In some instances, the targets are selected from Table 2. In some instances, the targets are selected from Table 4. In some instances, the targets are selected from Table 11.

In some embodiments, the probe set comprises a plurality of target sequences that hybridize to a plurality of targets, wherein the at least about 20% of the plurality of targets are targets selected from Tables 2, 4, 11 or 55. In some embodiments, the probe set comprises a plurality of target sequences that hybridize to a plurality of targets, wherein the at least about 25% of the plurality of targets are targets selected from Tables 2, 4, 11 or 55. In some embodiments, the probe set comprise a plurality of target sequences that hybridize to a plurality of targets, wherein the at least about 30% of the plurality of targets are targets selected from Tables 2, 4, 11 or 55. In some embodiments, the probe set comprise a plurality of target sequences that hybridize to a plurality of targets, wherein the at least about 35% of the plurality of targets are targets selected from Tables 2, 4, 11 or 55. In some embodiments, the probe set comprise a plurality of target sequences that hybridize to a plurality of targets, wherein the at least about 40% of the plurality of targets are targets selected from Tables 2, 4, 11 or 55. In some embodiments, the probe set comprise a plurality of target sequences that hybridize to a plurality of targets, wherein the at least about 45% of the plurality of targets are targets selected from Tables 2, 4, 11 or 55. In some embodiments, the probe set comprise a plurality of target sequences that hybridize to a plurality of targets, wherein the at least about 50% of the plurality of targets are targets selected from Tables 2, 4, 11 or 55. In some embodiments, the probe set comprise a plurality of target sequences that hybridize to a plurality of targets, wherein the at least about 60% of the plurality of targets are targets selected from Tables 2, 4, 11 or 55. In some embodiments, the probe set comprise a plurality of target sequences that hybridize to a plurality of targets, wherein the at least about 70% of the plurality of targets are targets selected from Tables 2, 4, 11 or 55. In some instances, the targets are selected from Table 2. In some instances, the targets are selected from Table 4. In some instances, the targets are selected from Table 11.

The system of the present invention further provides for primers and primer pairs capable of amplifying target sequences defined by the probe set, or fragments or subsequences or complements thereof. The nucleotide sequences of the probe set may be provided in computer-readable media for in silico applications and as a basis for the design of appropriate primers for amplification of one or more target sequences of the probe set.

Primers based on the nucleotide sequences of target sequences can be designed for use in amplification of the target sequences. For use in amplification reactions such as PCR, a pair of primers can be used. The exact composition of the primer sequences is not critical to the invention, but for most applications the primers may hybridize to specific sequences of the probe set under stringent conditions, particularly under conditions of high stringency, as known in the art. The pairs of primers are usually chosen so as to generate an amplification product of at least about 50 nucleotides, more usually at least about 100 nucleotides. Algorithms for the selection of primer sequences are generally known, and are available in commercial software packages. These primers may be used in standard quantitative or qualitative PCR-based assays to assess transcript expression levels of RNAs defined by the probe set. Alternatively, these primers may be used in combination with probes, such as molecular beacons in amplifications using real-time PCR.

In one embodiment, the primers or primer pairs, when used in an amplification reaction, specifically amplify at least a portion of a nucleic acid sequence of a target selected from any of Tables 2, 4, 11 and 55 (or subgroups thereof as set forth herein), an RNA form thereof, or a complement to either thereof. In some instances, the targets are selected from Table 2. In some instances, the targets are selected from Table 4. In some instances, the targets are selected from Table 11.

As is known in the art, a nucleoside is a base-sugar combination and a nucleotide is a nucleoside that further includes a phosphate group covalently linked to the sugar portion of the nucleoside. In forming oligonucleotides, the phosphate groups covalently link adjacent nucleosides to one another to form a linear polymeric compound, with the normal linkage or backbone of RNA and DNA being a 3' to 5' phosphodiester linkage. Specific examples of polynucleotide probes or primers useful in this invention include oligonucleotides containing modified backbones or non-natural internucleoside linkages. As defined in this specification, oligonucleotides having modified backbones include both those that retain a phosphorus atom in the backbone and those that lack a phosphorus atom in the backbone. For the purposes of the present invention, and as sometimes referenced in the art, modified oligonucleotides that do not have a phosphorus atom in their internucleoside backbone can also be considered to be oligonucleotides.

Exemplary polynucleotide probes or primers having modified oligonucleotide backbones include, for example, those with one or more modified internucleotide linkages that are phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'amino phosphoramidate and aminoalkylphosphoramidates, thionophosphoramidates, thionoalkyl-phosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms are also included.

Exemplary modified oligonucleotide backbones that do not include a phosphorus atom are formed by short chain alkyl or cycloalkyl internucleoside linkages, mixed heteroatom and alkyl or cycloalkyl internucleoside linkages, or one or more short chain heteroatomic or heterocyclic internucleoside linkages. Such backbones include morpholino linkages (formed in part from the sugar portion of a nucleoside); siloxane backbones; sulfide, sulfoxide and sulphone backbones; formacetyl and thioformacetyl backbones; methylene formacetyl and thioformacetyl backbones; alkene containing backbones; sulphamate backbones; methyleneimino and methylenehydrazino backbones; sulphonate and sulfonamide backbones; amide backbones; and others having mixed N, O, S and $CH_2$ component parts.

The present invention also contemplates oligonucleotide mimetics in which both the sugar and the internucleoside linkage of the nucleotide units are replaced with novel groups. The base units are maintained for hybridization with an appropriate nucleic acid target compound. An example of such an oligonucleotide mimetic, which has been shown to have excellent hybridization properties, is a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza-nitrogen atoms of the amide portion of the backbone.

The present invention also contemplates polynucleotide probes or primers comprising "locked nucleic acids" (LNAs), which may be novel conformationally restricted oligonucleotide analogues containing a methylene bridge that connects the 2'-O of ribose with the 4'-C. LNA and LNA analogues may display very high duplex thermal stabilities with complementary DNA and RNA, stability towards 3'-exonuclease degradation, and good solubility properties. Synthesis of the LNA analogues of adenine, cytosine, guanine, 5-methylcytosine, thymine and uracil, their oligomerization, and nucleic acid recognition properties have been described. Studies of mismatched sequences show that LNA obey the Watson-Crick base pairing rules with generally improved selectivity compared to the corresponding unmodified reference strands.

LNAs may form duplexes with complementary DNA or RNA or with complementary LNA, with high thermal affinities. The universality of LNA-mediated hybridization has been emphasized by the formation of exceedingly stable LNA:LNA duplexes. LNA:LNA hybridization was shown to be the most thermally stable nucleic acid type duplex system, and the RNA-mimicking character of LNA was established at the duplex level. Introduction of three LNA monomers (T or A) resulted in significantly increased melting points toward DNA complements.

Synthesis of 2'-amino-LNA and 2'-methylamino-LNA has been described and thermal stability of their duplexes with complementary RNA and DNA strands reported. Preparation of phosphorothioate-LNA and 2'-thio-LNA have also been described.

Modified polynucleotide probes or primers may also contain one or more substituted sugar moieties. For example, oligonucleotides may comprise sugars with one of the following substituents at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl. Examples of such groups are: $O[(CH_2)_n O]_m CH_3$, $O(CH_2)_n OCH_3$, $O(CH_2)_n NH_2$, $O(CH_2)_n CH_3 ONH_2$, and $O(CH_2)_n ON[(CH_2)_n CH_3)]_2$, where n and m are from 1 to about 10. Alternatively, the oligonucleotides may comprise one of the following substituents at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Specific examples include 2'-methoxyethoxy (2'-O—$CH_2CH_2OCH_3$, also known as 2'-O-(2-methoxyethyl) or 2'-MOE), 2'-dimethylaminooxyethoxy ($O(CH_2)2 ON(CH_3)_2$ group, also known as 2'-DMAOE), 2'-methoxy (2'-O—$CH_3$), 2'-aminopropoxy (2'-$OCH_2CH_2CH_2NH_2$) and 2'-fluoro (2'-F).

Similar modifications may also be made at other positions on the polynucleotide probes or primers, particularly the 3' position of the sugar on the 3' terminal nucleotide or in 2'-5' linked oligonucleotides and the 5' position of 5' terminal nucleotide. Polynucleotide probes or primers may also have sugar mimetics such as cyclobutyl moieties in place of the pentofuranosyl sugar.

Polynucleotide probes or primers may also include modifications or substitutions to the nucleobase. As used herein, "unmodified" or "natural" nucleobases include the purine bases adenine (A) and guanine (G), and the pyrimidine bases thymine (T), cytosine (C) and uracil (U).

Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Further nucleobases include those disclosed in U.S. Pat. No. 3,687,808; The Concise Encyclopedia Of Polymer Science And Engineering, (1990) pp 858-859, Kroschwitz, J. I., ed. John Wiley & Sons; Englisch et al., *Angewandte Chemie, Int. Ed.*, 30:613 (1991); and Sanghvi, Y. S., (1993)

*Antisense Research and Applications*, pp 289-302, Crooke, S. T. and Lebleu, B., ed., CRC Press. Certain of these nucleobases are particularly useful for increasing the binding affinity of the polynucleotide probes of the invention. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C.

One skilled in the art recognizes that it is not necessary for all positions in a given polynucleotide probe or primer to be uniformly modified. The present invention, therefore, contemplates the incorporation of more than one of the aforementioned modifications into a single polynucleotide probe or even at a single nucleoside within the probe or primer.

One skilled in the art also appreciates that the nucleotide sequence of the entire length of the polynucleotide probe or primer does not need to be derived from the target sequence. Thus, for example, the polynucleotide probe may comprise nucleotide sequences at the 5' and/or 3' termini that are not derived from the target sequences. Nucleotide sequences which are not derived from the nucleotide sequence of the target sequence may provide additional functionality to the polynucleotide probe. For example, they may provide a restriction enzyme recognition sequence or a "tag" that facilitates detection, isolation, purification or immobilization onto a solid support. Alternatively, the additional nucleotides may provide a self-complementary sequence that allows the primer/probe to adopt a hairpin configuration. Such configurations are necessary for certain probes, for example, molecular beacon and Scorpion probes, which can be used in solution hybridization techniques.

The polynucleotide probes or primers can incorporate moieties useful in detection, isolation, purification, or immobilization, if desired. Such moieties are well-known in the art (see, for example, Ausubel et al., (1997 & updates) *Current Protocols in Molecular Biology*, Wiley & Sons, New York) and are chosen such that the ability of the probe to hybridize with its target sequence is not affected.

Examples of suitable moieties are detectable labels, such as radioisotopes, fluorophores, chemiluminophores, enzymes, colloidal particles, and fluorescent microparticles, as well as antigens, antibodies, haptens, avidin/streptavidin, biotin, haptens, enzyme cofactors/substrates, enzymes, and the like.

A label can optionally be attached to or incorporated into a probe or primer polynucleotide to allow detection and/or quantitation of a target polynucleotide representing the target sequence of interest. The target polynucleotide may be the expressed target sequence RNA itself, a cDNA copy thereof, or an amplification product derived therefrom, and may be the positive or negative strand, so long as it can be specifically detected in the assay being used. Similarly, an antibody may be labeled.

In certain multiplex formats, labels used for detecting different targets may be distinguishable. The label can be attached directly (e.g., via covalent linkage) or indirectly, e.g., via a bridging molecule or series of molecules (e.g., a molecule or complex that can bind to an assay component, or via members of a binding pair that can be incorporated into assay components, e.g. biotin-avidin or streptavidin). Many labels are commercially available in activated forms which can readily be used for such conjugation (for example through amine acylation), or labels may be attached through known or determinable conjugation schemes, many of which are known in the art.

Labels useful in the invention described herein include any substance which can be detected when bound to or incorporated into the biomolecule of interest. Any effective detection method can be used, including optical, spectroscopic, electrical, piezoelectrical, magnetic, Raman scattering, surface plasmon resonance, colorimetric, calorimetric, etc. A label is typically selected from a chromophore, a lumiphore, a fluorophore, one member of a quenching system, a chromogen, a hapten, an antigen, a magnetic particle, a material exhibiting nonlinear optics, a semiconductor nanocrystal, a metal nanoparticle, an enzyme, an antibody or binding portion or equivalent thereof, an aptamer, and one member of a binding pair, and combinations thereof. Quenching schemes may be used, wherein a quencher and a fluorophore as members of a quenching pair may be used on a probe, such that a change in optical parameters occurs upon binding to the target introduce or quench the signal from the fluorophore. One example of such a system is a molecular beacon. Suitable quencher/fluorophore systems are known in the art. The label may be bound through a variety of intermediate linkages. For example, a polynucleotide may comprise a biotin-binding species, and an optically detectable label may be conjugated to biotin and then bound to the labeled polynucleotide. Similarly, a polynucleotide sensor may comprise an immunological species such as an antibody or fragment, and a secondary antibody containing an optically detectable label may be added.

Chromophores useful in the methods described herein include any substance which can absorb energy and emit light. For multiplexed assays, a plurality of different signaling chromophores can be used with detectably different emission spectra. The chromophore can be a lumophore or a fluorophore. Typical fluorophores include fluorescent dyes, semiconductor nanocrystals, lanthanide chelates, polynucleotide-specific dyes and green fluorescent protein.

Coding schemes may optionally be used, comprising encoded particles and/or encoded tags associated with different polynucleotides of the invention. A variety of different coding schemes are known in the art, including fluorophores, including SCNCs, deposited metals, and RF tags.

Polynucleotides from the described target sequences may be employed as probes for detecting target sequences expression, for ligation amplification schemes, or may be used as primers for amplification schemes of all or a portion of a target sequences. When amplified, either strand produced by amplification may be provided in purified and/or isolated form.

In one embodiment, polynucleotides of the invention include (a) a nucleic acid depicted in Tables 2, 4, 11 and 55; (b) an RNA form of any one of the nucleic acids depicted in Tables 2, 4, 11 and 55; (c) a peptide nucleic acid form of any of the nucleic acids depicted in Tables 2, 4, 11 and 55; (d) a nucleic acid comprising at least 20 consecutive bases of any of (a-c); (e) a nucleic acid comprising at least 25 bases having at least 90% sequenced identity to any of (a-c); and (f) a complement to any of (a-e).

Complements may take any polymeric form capable of base pairing to the species recited in (a)-(e), including nucleic acid such as RNA or DNA, or may be a neutral polymer such as a peptide nucleic acid. Polynucleotides of the invention can be selected from the subsets of the recited nucleic acids described herein, as well as their complements.

In some embodiments, polynucleotides of the invention comprise at least 20 consecutive bases of the nucleic acid sequence of a target selected from any of Tables 2, 4, 11 and 55 or a complement thereto. The polynucleotides may comprise at least 21, 22, 23, 24, 25, 27, 30, 32, 35 or more consecutive bases of the nucleic acids sequence of a target selected from any of Tables 2, 4, 11 and 55, as applicable. In some instances, the targets are selected from Table 2. In some instances, the targets are selected from Table 4. In some instances, the targets are selected from Table 11.

The polynucleotides may be provided in a variety of formats, including as solids, in solution, or in an array. The polynucleotides may optionally comprise one or more labels, which may be chemically and/or enzymatically incorporated into the polynucleotide.

In one embodiment, solutions comprising polynucleotide and a solvent are also provided. In some embodiments, the solvent may be water or may be predominantly aqueous. In some embodiments, the solution may comprise at least two, three, four, five, six, seven, eight, nine, ten, twelve, fifteen, seventeen, twenty or more different polynucleotides, including primers and primer pairs, of the invention. Additional substances may be included in the solution, alone or in combination, including one or more labels, additional solvents, buffers, biomolecules, polynucleotides, and one or more enzymes useful for performing methods described herein, including polymerases and ligases. The solution may further comprise a primer or primer pair capable of amplifying a polynucleotide of the invention present in the solution.

In some embodiments, one or more polynucleotides provided herein can be provided on a substrate. The substrate can comprise a wide range of material, either biological, nonbiological, organic, inorganic, or a combination of any of these. For example, the substrate may be a polymerized Langmuir Blodgett film, functionalized glass, Si, Ge, GaAs, GaP, $SiO_2$, $SiN_4$, modified silicon, or any one of a wide variety of gels or polymers such as (poly)tetrafluoroethylene, (poly)vinylidenedifluoride, polystyrene, cross-linked polystyrene, polyacrylic, polylactic acid, polyglycolic acid, poly(lactide coglycolide), polyanhydrides, poly(methyl methacrylate), poly(ethylene-co-vinyl acetate), polysiloxanes, polymeric silica, latexes, dextran polymers, epoxies, polycarbonates, or combinations thereof. Conducting polymers and photoconductive materials can be used.

Substrates can be planar crystalline substrates such as silica based substrates (e.g. glass, quartz, or the like), or crystalline substrates used in, e.g., the semiconductor and microprocessor industries, such as silicon, gallium arsenide, indium doped GaN and the like, and include semiconductor nanocrystals.

The substrate can take the form of an array, a photodiode, an optoelectronic sensor such as an optoelectronic semiconductor chip or optoelectronic thin-film semiconductor, or a biochip. The location(s) of probe(s) on the substrate can be addressable; this can be done in highly dense formats, and the location(s) can be microaddressable or nanoaddressable.

Silica aerogels can also be used as substrates, and can be prepared by methods known in the art. Aerogel substrates may be used as free standing substrates or as a surface coating for another substrate material.

The substrate can take any form and typically is a plate, slide, bead, pellet, disk, particle, microparticle, nanoparticle, strand, precipitate, optionally porous gel, sheets, tube, sphere, container, capillary, pad, slice, film, chip, multiwell plate or dish, optical fiber, etc. The substrate can be any form that is rigid or semi-rigid. The substrate may contain raised or depressed regions on which an assay component is located. The surface of the substrate can be etched using known techniques to provide for desired surface features, for example trenches, v-grooves, mesa structures, or the like.

Surfaces on the substrate can be composed of the same material as the substrate or can be made from a different material, and can be coupled to the substrate by chemical or physical means. Such coupled surfaces may be composed of any of a wide variety of materials, for example, polymers, plastics, resins, polysaccharides, silica or silica-based materials, carbon, metals, inorganic glasses, membranes, or any of the above-listed substrate materials. The surface can be optically transparent and can have surface Si—OH functionalities, such as those found on silica surfaces.

The substrate and/or its optional surface can be chosen to provide appropriate characteristics for the synthetic and/or detection methods used. The substrate and/or surface can be transparent to allow the exposure of the substrate by light applied from multiple directions. The substrate and/or surface may be provided with reflective "mirror" structures to increase the recovery of light.

The substrate and/or its surface is generally resistant to, or is treated to resist, the conditions to which it is to be exposed in use, and can be optionally treated to remove any resistant material after exposure to such conditions.

The substrate or a region thereof may be encoded so that the identity of the sensor located in the substrate or region being queried may be determined. Any suitable coding scheme can be used, for example optical codes, RFID tags, magnetic codes, physical codes, fluorescent codes, and combinations of codes.

Preparation of Probes and Primers

The polynucleotide probes or primers of the present invention can be prepared by conventional techniques well-known to those skilled in the art. For example, the polynucleotide probes can be prepared using solid-phase synthesis using commercially available equipment. As is well-known in the art, modified oligonucleotides can also be readily prepared by similar methods. The polynucleotide probes can also be synthesized directly on a solid support according to methods standard in the art. This method of synthesizing polynucleotides is particularly useful when the polynucleotide probes are part of a nucleic acid array.

Polynucleotide probes or primers can be fabricated on or attached to the substrate by any suitable method, for example the methods described in U.S. Pat. No. 5,143,854, PCT Publ. No. WO 92/10092, U.S. patent application Ser. No. 07/624,120, filed Dec. 6, 1990 (now abandoned), Fodor et al., Science, 251: 767-777 (1991), and PCT Publ. No. WO 90/15070). Techniques for the synthesis of these arrays using mechanical synthesis strategies are described in, e.g., PCT Publication No. WO 93/09668 and U.S. Pat. No. 5,384,261. Still further techniques include bead based techniques such as those described in PCT Appl. No. PCT/US93/04145 and pin based methods such as those described in U.S. Pat. No. 5,288,514. Additional flow channel or spotting methods applicable to attachment of sensor polynucleotides to a substrate are described in U.S. patent application Ser. No. 07/980,523, filed Nov. 20, 1992, and U.S. Pat. No. 5,384,261.

Alternatively, the polynucleotide probes of the present invention can be prepared by enzymatic digestion of the naturally occurring target gene, or mRNA or cDNA derived therefrom, by methods known in the art.

Diagnostic Samples

Diagnostic samples for use with the systems and in the methods of the present invention comprise nucleic acids suitable for providing RNAs expression information. In principle, the biological sample from which the expressed RNA is obtained and analyzed for target sequence expression can be any material suspected of comprising cancer tissue or cells. The diagnostic sample can be a biological sample used directly in a method of the invention. Alternatively, the diagnostic sample can be a sample prepared from a biological sample.

In one embodiment, the sample or portion of the sample comprising or suspected of comprising cancer tissue or cells can be any source of biological material, including cells, tissue or fluid, including bodily fluids. Non-limiting examples of the source of the sample include an aspirate, a needle biopsy, a cytology pellet, a bulk tissue preparation or a section thereof obtained for example by surgery or autopsy, lymph fluid, blood, plasma, serum, tumors, and organs. In some embodiments, the sample is from urine. Alternatively, the sample is from blood, plasma or serum. In some embodiments, the sample is from saliva.

The samples may be archival samples, having a known and documented medical outcome, or may be samples from current patients whose ultimate medical outcome is not yet known.

In some embodiments, the sample may be dissected prior to molecular analysis. The sample may be prepared via macrodissection of a bulk tumor specimen or portion thereof, or may be treated via microdissection, for example via Laser Capture Microdissection (LCM).

The sample may initially be provided in a variety of states, as fresh tissue, fresh frozen tissue, fine needle aspirates, and may be fixed or unfixed. Frequently, medical laboratories routinely prepare medical samples in a fixed state, which facilitates tissue storage. A variety of fixatives can be used to fix tissue to stabilize the morphology of cells, and may be used alone or in combination with other agents. Exemplary fixatives include crosslinking agents, alcohols, acetone, Bouin's solution, Zenker solution, Helv solution, osmic acid solution and Carnoy solution.

Crosslinking fixatives can comprise any agent suitable for forming two or more covalent bonds, for example an aldehyde. Sources of aldehydes typically used for fixation include formaldehyde, paraformaldehyde, glutaraldehyde or formalin. Preferably, the crosslinking agent comprises formaldehyde, which may be included in its native form or in the form of paraformaldehyde or formalin. One of skill in the art would appreciate that for samples in which crosslinking fixatives have been used special preparatory steps may be necessary including for example heating steps and proteinase-k digestion; see methods.

One or more alcohols may be used to fix tissue, alone or in combination with other fixatives. Exemplary alcohols used for fixation include methanol, ethanol and isopropanol.

Formalin fixation is frequently used in medical laboratories. Formalin comprises both an alcohol, typically methanol, and formaldehyde, both of which can act to fix a biological sample.

Whether fixed or unfixed, the biological sample may optionally be embedded in an embedding medium. Exemplary embedding media used in histology including paraffin, Tissue-Tek® V.I.P.™, Paramat, Paramat Extra, Paraplast, Paraplast X-tra, Paraplast Plus, Peel Away Paraffin Embedding Wax, Polyester Wax, Carbowax Polyethylene Glycol, Polyfin™, Tissue Freezing Medium TFMFM, Cryo-Gel™, and OCT Compound (Electron Microscopy Sciences, Hatfield, Pa.). Prior to molecular analysis, the embedding material may be removed via any suitable techniques, as known in the art. For example, where the sample is embedded in wax, the embedding material may be removed by extraction with organic solvent(s), for example xylenes. Kits are commercially available for removing embedding media from tissues. Samples or sections thereof may be subjected to further processing steps as needed, for example serial hydration or dehydration steps.

In some embodiments, the sample is a fixed, wax-embedded biological sample. Frequently, samples from medical laboratories are provided as fixed, wax-embedded samples, most commonly as formalin-fixed, paraffin embedded (FFPE) tissues.

Whatever the source of the biological sample, the target polynucleotide that is ultimately assayed can be prepared synthetically (in the case of control sequences), but typically is purified from the biological source and subjected to one or more preparative steps. The RNA may be purified to remove or diminish one or more undesired components from the biological sample or to concentrate it. Conversely, where the RNA is too concentrated for the particular assay, it may be diluted.

RNA Extraction

RNA can be extracted and purified from biological samples using any suitable technique. A number of techniques are known in the art, and several are commercially available (e.g., FormaPure nucleic acid extraction kit, Agencourt Biosciences, Beverly Mass., High Pure FFPE RNA Micro Kit, Roche Applied Science, Indianapolis, Ind.). RNA can be extracted from frozen tissue sections using TRIzol (Invitrogen, Carlsbad, Calif.) and purified using RNeasy Protect kit (Qiagen, Valencia, Calif.). RNA can be further purified using DNAse I treatment (Ambion, Austin, Tex.) to eliminate any contaminating DNA. RNA concentrations can be made using a Nanodrop ND-1000 spectrophotometer (Nanodrop Technologies, Rockland, Del.). RNA can be further purified to eliminate contaminants that interfere with cDNA synthesis by cold sodium acetate precipitation. RNA integrity can be evaluated by running electropherograms, and RNA integrity number (RIN, a correlative measure that indicates intactness of mRNA) can be determined using the RNA 6000 PicoAssay for the Bioanalyzer 2100 (Agilent Technologies, Santa Clara, Calif.).

Kits

Kits for performing the desired method(s) are also provided, and comprise a container or housing for holding the components of the kit, one or more vessels containing one or more nucleic acid(s), and optionally one or more vessels containing one or more reagents. The reagents include those described in the composition of matter section above, and those reagents useful for performing the methods described, including amplification reagents, and may include one or more probes, primers or primer pairs, enzymes (including polymerases and ligases), intercalating dyes, labeled probes, and labels that can be incorporated into amplification products.

In some embodiments, the kit comprises primers or primer pairs specific for those subsets and combinations of target sequences described herein. At least two, three, four or five primers or pairs of primers suitable for selectively amplifying the same number of target sequence-specific polynucleotides can be provided in kit form. In some embodiments, the kit comprises from five to fifty primers or pairs of primers suitable for amplifying the same number of target sequence-representative polynucleotides of interest.

In some embodiments, the primers or primer pairs of the kit, when used in an amplification reaction, specifically amplify a non-coding target, coding target, or non-exonic target described herein, at least a portion of a nucleic acid sequence depicted in one of SEQ ID NOs: 1-43, a nucleic acid sequence corresponding to a target selected from Tables 2, 4, 11 or 55, an RNA form thereof, or a complement to either thereof. The kit may include a plurality of such primers or primer pairs which can specifically amplify a corresponding plurality of different amplify a non-coding target, coding target, or non-exonic transcript described herein, nucleic acids depicted in one of SEQ ID NOs: 1-43, a nucleic acid sequence corresponding to a target selected from Tables 2, 4, 11 or 55, RNA forms thereof, or complements thereto. At least two, three, four or five primers or pairs of primers suitable for selectively amplifying the same number of target sequence-specific polynucleotides can be provided in kit form. In some embodiments, the kit comprises from five to fifty primers or pairs of primers suitable for amplifying the same number of target sequence-representative polynucleotides of interest. In some instances, the targets are selected from Table 2. In some instances, the targets are selected from Table 4. In some instances, the targets are selected from Table 11.

The reagents may independently be in liquid or solid form. The reagents may be provided in mixtures. Control samples and/or nucleic acids may optionally be provided in the kit. Control samples may include tissue and/or nucleic acids obtained from or representative of tumor samples from patients showing no evidence of disease, as well as tissue and/or nucleic acids obtained from or representative of tumor samples from patients that develop systemic cancer.

The nucleic acids may be provided in an array format, and thus an array or microarray may be included in the kit. The kit optionally may be certified by a government agency for use in prognosing the disease outcome of cancer patients and/or for designating a treatment modality.

Instructions for using the kit to perform one or more methods of the invention can be provided with the container, and can be provided in any fixed medium. The instructions may be located inside or outside the container or housing, and/or may be printed on the interior or exterior of any surface thereof. A kit may be in multiplex form for concurrently detecting and/or quantitating one or more different target polynucleotides representing the expressed target sequences.

Devices

Devices useful for performing methods of the invention are also provided. The devices can comprise means for characterizing the expression level of a target sequence of the invention, for example components for performing one or more methods of nucleic acid extraction, amplification, and/or detection. Such components may include one or more of an amplification chamber (for example a thermal cycler), a plate reader, a spectrophotometer, capillary electrophoresis apparatus, a chip reader, and or robotic sample handling components. These components ultimately can obtain data that reflects the expression level of the target sequences used in the assay being employed.

The devices may include an excitation and/or a detection means. Any instrument that provides a wavelength that can excite a species of interest and is shorter than the emission wavelength(s) to be detected can be used for excitation. Commercially available devices can provide suitable excitation wavelengths as well as suitable detection component.

Exemplary excitation sources include a broadband UV light source such as a deuterium lamp with an appropriate filter, the output of a white light source such as a xenon lamp or a deuterium lamp after passing through a monochromator to extract out the desired wavelength(s), a continuous wave (cw) gas laser, a solid state diode laser, or any of the pulsed lasers. Emitted light can be detected through any suitable device or technique; many suitable approaches are known in the art. For example, a fluorimeter or spectrophotometer may be used to detect whether the test sample emits light of a wavelength characteristic of a label used in an assay.

The devices typically comprise a means for identifying a given sample, and of linking the results obtained to that sample. Such means can include manual labels, barcodes, and other indicators which can be linked to a sample vessel, and/or may optionally be included in the sample itself, for example where an encoded particle is added to the sample. The results may be linked to the sample, for example in a computer memory that contains a sample designation and a record of expression levels obtained from the sample. Linkage of the results to the sample can also include a linkage to a particular sample receptacle in the device, which is also linked to the sample identity.

In some instances, the devices also comprise a means for correlating the expression levels of the target sequences being studied with a prognosis of disease outcome. In some instances, such means comprises one or more of a variety of correlative techniques, including lookup tables, algorithms, multivariate models, and linear or nonlinear combinations of expression models or algorithms. The expression levels may be converted to one or more likelihood scores, reflecting likelihood that the patient providing the sample may exhibit a particular disease outcome. The models and/or algorithms can be provided in machine readable format and can optionally further designate a treatment modality for a patient or class of patients.

The device also comprises output means for outputting the disease status, prognosis and/or a treatment modality. Such output means can take any form which transmits the results to a patient and/or a healthcare provider, and may include a monitor, a printed format, or both. The device may use a computer system for performing one or more of the steps provided.

In some embodiments, the method, systems, and kits disclosed herein further comprise the transmission of data/information. For example, data/information derived from the detection and/or quantification of the target may be transmitted to another device and/or instrument. In some instances, the information obtained from an algorithm is transmitted to another device and/or instrument. Transmission of the data/information may comprise the transfer of data/information from a first source to a second source. The first and second sources may be in the same approximate location (e.g., within the same room, building, block, campus). Alternatively, first and second sources may be in multiple locations (e.g., multiple cities, states, countries, continents, etc).

In some instances, transmission of the data/information comprises digital transmission or analog transmission. Digital transmission may comprise the physical transfer of data (a digital bit stream) over a point-to-point or point-to-multipoint communication channel. Examples of such channels are copper wires, optical fibers, wireless communication channels, and storage media. In some embodiments, the data is represented as an electromagnetic signal, such as an electrical voltage, radiowave, microwave, or infrared signal.

Analog transmission may comprise the transfer of a continuously varying analog signal. The messages can either be represented by a sequence of pulses by means of a line code (baseband transmission), or by a limited set of continuously varying wave forms (passband transmission), using a digital modulation method. The passband modulation and corresponding demodulation (also known as detection) can be carried out by modem equipment. According to the most common definition of digital signal, both baseband and passband signals representing bit-streams are considered as digital transmission, while an alternative definition only considers the baseband signal as digital, and passband transmission of digital data as a form of digital-to-analog conversion.

Amplification and Hybridization

Following sample collection and nucleic acid extraction, the nucleic acid portion of the sample comprising RNA that is or can be used to prepare the target polynucleotide(s) of interest can be subjected to one or more preparative reactions. These preparative reactions can include in vitro transcription (IVT), labeling, fragmentation, amplification and other reactions. mRNA can first be treated with reverse transcriptase and a primer to create cDNA prior to detection, quantitation and/or amplification; this can be done in vitro with purified mRNA or in situ, e.g., in cells or tissues affixed to a slide.

By "amplification" is meant any process of producing at least one copy of a nucleic acid, in this case an expressed RNA, and in many cases produces multiple copies. An amplification product can be RNA or DNA, and may include a complementary strand to the expressed target sequence. DNA amplification products can be produced initially through reverse translation and then optionally from further amplification reactions. The amplification product may include all or a portion of a target sequence, and may optionally be labeled. A variety of amplification methods are suitable for use, including polymerase-based methods and ligation-based methods. Exemplary amplification techniques include the polymerase chain reaction method (PCR), the lipase chain reaction (LCR), ribozyme-based methods, self sustained sequence replication (3SR), nucleic acid sequence-based amplification (NASBA), the use of Q Beta replicase, reverse transcription, nick translation, and the like.

Asymmetric amplification reactions may be used to preferentially amplify one strand representing the target sequence that is used for detection as the target polynucleotide. In some cases, the presence and/or amount of the amplification product itself may be used to determine the expression level of a given target sequence. In other instances, the amplification product may be used to hybridize to an array or other substrate comprising sensor polynucleotides which are used to detect and/or quantitate target sequence expression.

The first cycle of amplification in polymerase-based methods typically forms a primer extension product complementary to the template strand. If the template is single-stranded RNA, a polymerase with reverse transcriptase activity is used in the first amplification to reverse transcribe the RNA to DNA, and additional amplification cycles can be performed to copy the primer extension products. The primers for a PCR must, of course, be designed to hybridize to regions in their corresponding template that can produce an amplifiable segment; thus, each primer must hybridize so that its 3' nucleotide is paired to a nucleotide in its complementary template strand that is located 3' from the 3' nucleotide of the primer used to replicate that complementary template strand in the PCR.

The target polynucleotide can be amplified by contacting one or more strands of the target polynucleotide with a primer and a polymerase having suitable activity to extend the primer and copy the target polynucleotide to produce a full-length complementary polynucleotide or a smaller portion thereof. Any enzyme having a polymerase activity that can copy the target polynucleotide can be used, including DNA polymerases, RNA polymerases, reverse transcriptases, enzymes having more than one type of polymerase or enzyme activity. The enzyme can be thermolabile or thermostable. Mixtures of enzymes can also be used. Exemplary enzymes include: DNA polymerases such as DNA Polymerase I ("Pol I"), the Klenow fragment of Pol I, T4, T7, Sequenase® T7, Sequenase® Version 2.0 T7, Tub, Taq, Tth, Pfic, Pfu, Tsp, Tfl, Tli and *Pyrococcus* sp GB-D DNA polymerases; RNA polymerases such as *E. coil*, SP6, T3 and T7 RNA polymerases; and reverse transcriptases such as AMV, M-MuLV, MMLV, RNAse H MMLV (SuperScript®), SuperScript® II, ThermoScript®, HIV-1, and RAV2 reverse transcriptases. All of these enzymes are commercially available. Exemplary polymerases with multiple specificities include RAV2 and Tli (exo-) polymerases. Exemplary thermostable polymerases include Tub, Taq, Tth, Pfic, Pfu, Tsp, Tfl, Tli and *Pyrococcus* sp. GB-D DNA polymerases.

Suitable reaction conditions are chosen to permit amplification of the target polynucleotide, including pH, buffer, ionic strength, presence and concentration of one or more salts, presence and concentration of reactants and cofactors such as nucleotides and magnesium and/or other metal ions (e.g., manganese), optional cosolvents, temperature, thermal cycling profile for amplification schemes comprising a polymerase chain reaction, and may depend in part on the polymerase being used as well as the nature of the sample. Cosolvents include formamide (typically at from about 2 to about 10%), glycerol (typically at from about 5 to about 10%), and DMSO (typically at from about 0.9 to about 10%). Techniques may be used in the amplification scheme in order to minimize the production of false positives or artifacts produced during amplification. These include "touchdown" PCR, hot-start techniques, use of nested primers, or designing PCR primers so that they form stem-loop structures in the event of primer-dimer formation and thus are not amplified. Techniques to accelerate PCR can be used, for example centrifugal PCR, which allows for greater convection within the sample, and comprising infrared heating steps for rapid heating and cooling of the sample. One or more cycles of amplification can be performed. An excess of one primer can be used to produce an excess of one primer extension product during PCR; preferably, the primer extension product produced in excess is the amplification product to be detected. A plurality of different primers may be used to amplify different target polynucleotides or different regions of a particular target polynucleotide within the sample.

An amplification reaction can be performed under conditions which allow an optionally labeled sensor polynucleotide to hybridize to the amplification product during at least part of an amplification cycle. When the assay is performed in this manner, real-time detection of this hybridization event can take place by monitoring for light emission or fluorescence during amplification, as known in the art.

Where the amplification product is to be used for hybridization to an array or microarray, a number of suitable commercially available amplification products are available. These include amplification kits available from NuGEN, Inc. (San Carlos, Calif.), including the WT-Ovation™ System, WT-Ovation™ System v2, WT-Ovation™ Pico System, WT-Ovation™ FFPE Exon Module, WT-Ovation™ FFPE Exon Module RiboAmp and RiboAmp Plus RNA Amplification Kits (MDS Analytical Technologies (formerly Arcturus) (Mountain View, Calif.), Genisphere, Inc. (Hatfield, Pa.), including the RampUp Plus™ and SenseAmp™ RNA Amplification kits, alone or in combination. Amplified nucleic acids may be subjected to one or more purification reactions after amplification and labeling, for example using magnetic beads (e.g., RNAClean magnetic beads, Agencourt Biosciences).

Multiple RNA biomarkers can be analyzed using real-time quantitative multiplex RT-PCR platforms and other multiplexing technologies such as GenomeLab GeXP Genetic Analysis System (Beckman Coulter, Foster City, Calif.), SmartCycler® 9600 or GeneXpert® Systems (Cepheid, Sunnyvale, Calif.), ABI 7900 HT Fast Real Time PCR system (Applied Biosystems, Foster City, Calif.), LightCycler® 480 System (Roche Molecular Systems, Pleasanton, Calif.), xMAP 100 System (Luminex, Austin, Tex.) Solexa Genome Analysis System (Illumina, Hayward, Calif.), OpenArray Real Time qPCR (BioTrove, Woburn, Mass.) and BeadXpress System (Illumina, Hayward, Calif.).

Detection and/or Quantification of Target Sequences

Any method of detecting and/or quantitating the expression of the encoded target sequences can in principle be used in the invention. The expressed target sequences can be directly detected and/or quantitated, or may be copied and/or amplified to allow detection of amplified copies of the expressed target sequences or its complement.

Methods for detecting and/or quantifying a target can include Northern blotting, sequencing, array or microarray hybridization, by enzymatic cleavage of specific structures (e.g., an Invader® assay, Third Wave Technologies, e.g. as described in U.S. Pat. Nos. 5,846,717, 6,090,543; 6,001,567; 5,985,557; and 5,994,069) and amplification methods, e.g. RT-PCR, including in a TaqMan® assay (PE Biosystems, Foster City, Calif., e.g. as described in U.S. Pat. Nos. 5,962,233 and 5,538,848), and may be quantitative or semi-quantitative, and may vary depending on the origin, amount and condition of the available biological sample. Combinations of these methods may also be used. For example, nucleic acids may be amplified, labeled and subjected to microarray analysis.

In some instances, target sequences may be detected by sequencing. Sequencing methods may comprise whole genome sequencing or exome sequencing. Sequencing methods such as Maxim-Gilbert, chain-termination, or high-throughput systems may also be used. Additional, suitable sequencing techniques include classic dideoxy sequencing reactions (Sanger method) using labeled terminators or primers and gel separation in slab or capillary, sequencing by synthesis using reversibly terminated labeled nucleotides, pyrosequencing, 454 sequencing, allele specific hybridization to a library of labeled oligonucleotide probes, sequencing by synthesis using allele specific hybridization to a library of labeled clones that is followed by ligation, real time monitoring of the incorporation of labeled nucleotides during a polymerization step, and SOLiD sequencing.

Additional methods for detecting and/or quantifying a target include single-molecule sequencing (e.g., Helicos, PacBio), sequencing by synthesis (e.g., Illumina, Ion Torrent), sequencing by ligation (e.g., ABI SOLID), sequencing by hybridization (e.g., Complete Genomics), in situ hybridization, bead-array technologies (e.g., Luminex xMAP, Illumina BeadChips), branched DNA technology (e.g., Panomics, Genisphere). Sequencing methods may use fluorescent (e.g., Illumina) or electronic (e.g., Ion Torrent, Oxford Nanopore) methods of detecting nucleotides.

Reverse Transcription for ORT-PCR Analysis

Reverse transcription can be performed by any method known in the art. For example, reverse transcription may be performed using the Omniscript kit (Qiagen, Valencia, Calif.), Superscript III kit (Invitrogen, Carlsbad, Calif.), for RT-PCR. Target-specific priming can be performed in order to increase the sensitivity of detection of target sequences and generate target-specific cDNA.

TaqMan® Gene Expression Analysis

TaqMan®RT-PCR can be performed using Applied Biosystems Prism (ABI) 7900 HT instruments in a 5 1.11 volume with target sequence-specific cDNA equivalent to 1 ng total RNA.

Primers and probes concentrations for TaqMan analysis are added to amplify fluorescent amplicons using PCR cycling conditions such as 95° C. for 10 minutes for one cycle, 95° C. for 20 seconds, and 60° C. for 45 seconds for 40 cycles. A reference sample can be assayed to ensure reagent and process stability. Negative controls (e.g., no template) should be assayed to monitor any exogenous nucleic acid contamination.

Classification Arrays

The present invention contemplates that a probe set or probes derived therefrom may be provided in an array format. In the context of the present invention, an "array" is a spatially or logically organized collection of polynucleotide probes. An array comprising probes specific for a coding target, non-coding target, or a combination thereof may be used. Alternatively, an array comprising probes specific for two or more of transcripts of a target selected from any of Tables 2, 4, 11 and 55 or a product derived thereof can be used. Desirably, an array may be specific for 5, 10, 15, 20, 25, 30, 50, 75, 100, 150, 200 or more of transcripts of a target selected from any of Tables 2, 4, 11 and 55. In some instances, the target is selected from Table 2. In other instances, the target is selected from Table 4. In some embodiments, the target is selected from Table 11. Expression of these sequences may be detected alone or in combination with other transcripts. In some embodiments, an array is used which comprises a wide range of sensor probes for prostate-specific expression products, along with appropriate control sequences. In some instances, the array may comprise the Human Exon 1.0 ST Array (HuEx 1.0 ST, Affymetrix, Inc., Santa Clara, Calif.).

Typically the polynucleotide probes are attached to a solid substrate and are ordered so that the location (on the substrate) and the identity of each are known. The polynucleotide probes can be attached to one of a variety of solid substrates capable of withstanding the reagents and conditions necessary for use of the array. Examples include, but are not limited to, polymers, such as (poly)tetrafluoroethylene, (poly)vinylidenedifluoride, polystyrene, polycarbonate, polypropylene and polystyrene; ceramic; silicon; silicon dioxide; modified silicon; (fused) silica, quartz or glass; functionalized glass; paper, such as filter paper; diazotized cellulose; nitrocellulose filter; nylon membrane; and polyacrylamide gel pad. Substrates that are transparent to light are useful for arrays that may be used in an assay that involves optical detection.

Examples of array formats include membrane or filter arrays (for example, nitrocellulose, nylon arrays), plate arrays (for example, multiwell, such as a 24-, 96-, 256-, 384-, 864- or 1536-well, microtitre plate arrays), pin arrays, and bead arrays (for example, in a liquid "slurry"). Arrays on substrates such as glass or ceramic slides are often referred to as chip arrays or "chips." Such arrays are well known in the art. In one embodiment of the present invention, the Cancer Prognosticarray is a chip.

Data Analysis

In some embodiments, one or more pattern recognition methods can be used in analyzing the expression level of target sequences. The pattern recognition method can comprise a linear combination of expression levels, or a nonlinear combination of expression levels. In some embodiments, expression measurements for RNA transcripts or combinations of RNA transcript levels are formulated into linear or non-linear models or algorithms (e.g., an 'expression signature') and converted into a likelihood score. This likelihood score indicates the probability that a biological sample is from a patient who may exhibit no evidence of disease, who may exhibit systemic cancer, or who may exhibit biochemical recurrence. The likelihood score can be used to distinguish these disease states. The models and/or algorithms can be provided in machine readable format, and may be used to correlate expression levels or an expression profile with a disease state, and/or to designate a treatment modality for a patient or class of patients.

Assaying the expression level for a plurality of targets may comprise the use of an algorithm or classifier. Array data can be managed, classified, and analyzed using techniques known in the art. Assaying the expression level for a plurality of targets may comprise probe set modeling and data pre-processing. Probe set modeling and data pre-processing can be derived using the Robust Multi-Array (RMA) algorithm or variants GC-RMA, fRMA, Probe Logarithmic Intensity Error (PLIER) algorithm or variant iterPLIER. Variance or intensity filters can be applied to pre-process data using the RMA algorithm, for example by removing target sequences with a standard deviation of <10 or a mean intensity of <100 intensity units of a normalized data range, respectively.

Alternatively, assaying the expression level for a plurality of targets may comprise the use of a machine learning algorithm. The machine learning algorithm may comprise a supervised learning algorithm. Examples of supervised learning algorithms may include Average One-Dependence Estimators (AODE), Artificial neural network (e.g., Backpropagation), Bayesian statistics (e.g., Naive Bayes classifier, Bayesian network, Bayesian knowledge base), Case-based reasoning, Decision trees, Inductive logic programming, Gaussian process regression, Group method of data handling (GMDH), Learning Automata, Learning Vector Quantization, Minimum message length (decision trees, decision graphs, etc.), Lazy learning, Instance-based learning Nearest Neighbor Algorithm, Analogical modeling, Probably approximately correct learning (PAC) learning, Ripple down rules, a knowledge acquisition methodology, Symbolic machine learning algorithms, Subsymbolic machine learning algorithms, Support vector machines, Random Forests, Ensembles of classifiers, Bootstrap aggregating (bagging), and Boosting. Supervised learning may comprise ordinal classification such as regression analysis and Information fuzzy networks (IFN). Alternatively, supervised learning methods may comprise statistical classification, such as AODE, Linear classifiers (e.g., Fisher's linear discriminant, Logistic regression, Naive Bayes classifier, Perceptron, and Support vector machine), quadratic classifiers, k-nearest neighbor, Boosting, Decision trees (e.g., C4.5, Random forests), Bayesian networks, and Hidden Markov models.

The machine learning algorithms may also comprise an unsupervised learning algorithm. Examples of unsupervised learning algorithms may include artificial neural network, Data clustering, Expectation-maximization algorithm, Self-organizing map, Radial basis function network, Vector Quantization, Generative topographic map, Information bottleneck method, and IBSEAD. Unsupervised learning may also comprise association rule learning algorithms such as Apriori algorithm, Eclat algorithm and FP-growth algorithm. Hierarchical clustering, such as Single-linkage clustering and Conceptual clustering, may also be used. Alternatively, unsupervised learning may comprise partitional clustering such as K-means algorithm and Fuzzy clustering.

In some instances, the machine learning algorithms comprise a reinforcement learning algorithm. Examples of reinforcement learning algorithms include, but are not limited to, temporal difference learning, Q-learning and Learning Automata. Alternatively, the machine learning algorithm may comprise Data Pre-processing.

Preferably, the machine learning algorithms may include, but are not limited to, Average One-Dependence Estimators (AODE), Fisher's linear discriminant, Logistic regression, Perceptron, Multilayer Perceptron, Artificial Neural Networks, Support vector machines, Quadratic classifiers, Boosting, Decision trees, C4.5, Bayesian networks, Hidden Markov models, High-Dimensional Discriminant Analysis, and Gaussian Mixture Models. The machine learning algorithm may comprise support vector machines, Naïve Bayes classifier, k-nearest neighbor, high-dimensional discriminant analysis, or Gaussian mixture models. In some instances, the machine learning algorithm comprises Random Forests.

Additional Techniques and Tests

Factors known in the art for diagnosing and/or suggesting, selecting, designating, recommending or otherwise determining a course of treatment for a patient or class of patients suspected of having cancer can be employed in combination with measurements of the target sequence expression. The methods disclosed herein may include additional techniques such as cytology, histology, ultrasound analysis, MRI results, CT scan results, and measurements of PSA levels.

Certified tests for classifying disease status and/or designating treatment modalities may also be used in diagnosing, predicting, and/or monitoring the status or outcome of a cancer in a subject. A certified test may comprise a means for characterizing the expression levels of one or more of the target sequences of interest, and a certification from a government regulatory agency endorsing use of the test for classifying the disease status of a biological sample.

In some embodiments, the certified test may comprise reagents for amplification reactions used to detect and/or quantitate expression of the target sequences to be characterized in the test. An array of probe nucleic acids can be used, with or without prior target amplification, for use in measuring target sequence expression.

The test is submitted to an agency having authority to certify the test for use in distinguishing disease status and/or outcome. Results of detection of expression levels of the target sequences used in the test and correlation with disease status and/or outcome are submitted to the agency. A certification authorizing the diagnostic and/or prognostic use of the test is obtained.

Also provided are portfolios of expression levels comprising a plurality of normalized expression levels of the target selected from any of Tables 2, 4, 11 and 55. In some instances, the target is selected from Table 2. In other instances, the target is selected from Table 4. In some embodiments, the target is selected from Table 11. Such portfolios may be provided by performing the methods described herein to obtain expression levels from an individual patient or from a group of patients. The expression levels can be normalized by any method known in the art; exemplary normalization methods that can be used in various embodiments include Robust Multichip Average (RMA), probe logarithmic intensity error estimation (PLIER), non-linear fit (NLFIT) quantile-based and nonlinear normalization, and combinations thereof. Background correction can also be performed on the expression data;

exemplary techniques useful for background correction include mode of intensities, normalized using median polish probe modeling and sketch-normalization.

In some embodiments, portfolios are established such that the combination of genes in the portfolio exhibit improved sensitivity and specificity relative to known methods. In considering a group of genes for inclusion in a portfolio, a small standard deviation in expression measurements correlates with greater specificity. Other measurements of variation such as correlation coefficients can also be used in this capacity. The invention also encompasses the above methods where the expression level determines the status or outcome of a cancer in the subject with at least about 45% specificity. In some embodiments, the expression level determines the status or outcome of a cancer in the subject with at least about 50% specificity. In some embodiments, the expression level determines the status or outcome of a cancer in the subject with at least about 55% specificity. In some embodiments, the expression level determines the status or outcome of a cancer in the subject with at least about 60% specificity. In some embodiments, the expression level determines the status or outcome of a cancer in the subject with at least about 65% specificity. In some embodiments, the expression level determines the status or outcome of a cancer in the subject with at least about 70% specificity. In some embodiments, the expression level determines the status or outcome of a cancer in the subject with at least about 75% specificity. In some embodiments, the expression level determines the status or outcome of a cancer in the subject with at least about 80% specificity. In some embodiments, t the expression level determines the status or outcome of a cancer in the subject with at least about 85% specificity. In some embodiments, the expression level determines the status or outcome of a cancer in the subject with at least about 90% specificity. In some embodiments, the expression level determines the status or outcome of a cancer in the subject with at least about 95% specificity.

The invention also encompasses the any of the methods disclosed herein where the accuracy of diagnosing, monitoring, and/or predicting a status or outcome of a cancer is at least about 45%. In some embodiments, the accuracy of diagnosing, monitoring, and/or predicting a status or outcome of a cancer is at least about 50%. In some embodiments, the accuracy of diagnosing, monitoring, and/or predicting a status or outcome of a cancer is at least about 55%. In some embodiments, the accuracy of diagnosing, monitoring, and/or predicting a status or outcome of a cancer is at least about 60%. In some embodiments, the accuracy of diagnosing, monitoring, and/or predicting a status or outcome of a cancer is at least about 65%. In some embodiments, the accuracy of diagnosing, monitoring, and/or predicting a status or outcome of a cancer is at least about 70%. In some embodiments, the accuracy of diagnosing, monitoring, and/or predicting a status or outcome of a cancer is at least about 75%. In some embodiments, the accuracy of diagnosing, monitoring, and/or predicting a status or outcome of a cancer is at least about 80%. In some embodiments, the accuracy of diagnosing, monitoring, and/or predicting a status or outcome of a cancer is at least about 85%. In some embodiments, the accuracy of diagnosing, monitoring, and/or predicting a status or outcome of a cancer is at least about 90%. In some embodiments, the accuracy of diagnosing, monitoring, and/or predicting a status or outcome of a cancer is at least about 95%.

The accuracy of a classifier or biomarker may be determined by the 95% confidence interval (CI). Generally, a classifier or biomarker is considered to have good accuracy if the 95% CI does not overlap 1. In some instances, the 95% CI of a classifier or biomarker is at least about 1.08, 1.10, 1.12, 1.14, 1.15, 1.16, 1.17, 1.18, 1.19, 1.20, 1.21, 1.22, 1.23, 1.24, 1.25, 1.26, 1.27, 1.28, 1.29, 1.30, 1.31, 1.32, 1.33, 1.34, or 1.35 or more. The 95% CI of a classifier or biomarker may be at least about 1.14, 1.15, 1.16, 1.20, 1.21, 1.26, or 1.28. The 95% CI of a classifier or biomarker may be less than about 1.75, 1.74, 1.73, 1.72, 1.71, 1.70, 1.69, 1.68, 1.67, 1.66, 1.65, 1.64, 1.63, 1.62, 1.61, 1.60, 1.59, 1.58, 1.57, 1.56, 1.55, 1.54, 1.53, 1.52, 1.51, 1.50 or less. The 95% CI of a classifier or biomarker may be less than about 1.61, 1.60, 1.59, 1.58, 1.56, 1.55, or 1.53. The 95% CI of a classifier or biomarker may be between about 1.10 to 1.70, between about 1.12 to about 1.68, between about 1.14 to about 1.62, between about 1.15 to about 1.61, between about 1.15 to about 1.59, between about 1.16 to about 1.160, between about 1.19 to about 1.55, between about 1.20 to about 1.54, between about 1.21 to about 1.53, between about 1.26 to about 1.63, between about 1.27 to about 1.61, or between about 1.28 to about 1.60.

In some instances, the accuracy of a biomarker or classifier is dependent on the difference in range of the 95% CI (e.g., difference in the high value and low value of the 95% CI interval). Generally, biomarkers or classifiers with large differences in the range of the 95% CI interval have greater variability and are considered less accurate than biomarkers or classifiers with small differences in the range of the 95% CI intervals. In some instances, a biomarker or classifier is considered more accurate if the difference in the range of the 95% CI is less than about 0.60, 0.55, 0.50, 0.49, 0.48, 0.47, 0.46, 0.45, 0.44, 0.43, 0.42, 0.41, 0.40, 0.39, 0.38, 0.37, 0.36, 0.35, 0.34, 0.33, 0.32, 0.31, 0.30, 0.29, 0.28, 0.27, 0.26, 0.25 or less. The difference in the range of the 95% CI of a biomarker or classifier may be less than about 0.48, 0.45, 0.44, 0.42, 0.40, 0.37, 0.35, 0.33, or 0.32. In some instances, the difference in the range of the 95% CI for a biomarker or classifier is between about 0.25 to about 0.50, between about 0.27 to about 0.47, or between about 0.30 to about 0.45.

The invention also encompasses the any of the methods disclosed herein where the sensitivity is at least about 45%. In some embodiments, the sensitivity is at least about 50%. In some embodiments, the sensitivity is at least about 55%. In some embodiments, the sensitivity is at least about 60%. In some embodiments, the sensitivity is at least about 65%. In some embodiments, the sensitivity is at least about 70%. In some embodiments, the sensitivity is at least about 75%. In some embodiments, the sensitivity is at least about 80%. In some embodiments, the sensitivity is at least about 85%. In some embodiments, the sensitivity is at least about 90%. In some embodiments, the sensitivity is at least about 95%.

In some instances, the classifiers or biomarkers disclosed herein are clinically significant. In some instances, the clinical significance of the classifiers or biomarkers is determined by the AUC value. In order to be clinically significant, the AUC value is at least about 0.5, 0.55, 0.6, 0.65, 0.7, 0.75, 0.8, 0.85, 0.9, or 0.95. The clinical significance of the classifiers or biomarkers can be determined by the percent accuracy. For example, a classifier or biomarker is determined to be clinically significant if the accuracy of the classifier or biomarker is at least about 50%, 55%, 60%, 65%, 70%, 72%, 75%, 77%, 80%, 82%, 84%, 86%, 88%, 90%, 92%, 94%, 96%, or 98%.

In other instances, the clinical significance of the classifiers or biomarkers is determined by the median fold difference (MDF) value. In order to be clinically significant, the MDF value is at least about 0.8, 0.9, 1.0, 1.1, 1.2, 1.3, 1.4, 1.5, 1.6, 1.7, 1.9, or 2.0. In some instances, the MDF value is greater than or equal to 1.1. In other instances, the MDF value is greater than or equal to 1.2. Alternatively, or additionally, the clinical significance of the classifiers or biomarkers is determined by the t-test P-value. In some instances, in order to be clinically significant, the t-test P-value is less than about 0.070, 0.065, 0.060, 0.055, 0.050, 0.045, 0.040, 0.035, 0.030, 0.025, 0.020, 0.015, 0.010, 0.005, 0.004, or 0.003. The t-test P-value can be less than about 0.050. Alternatively, the t-test P-value is less than about 0.010.

In some instances, the clinical significance of the classifiers or biomarkers is determined by the clinical outcome. For example, different clinical outcomes can have different minimum or maximum thresholds for AUC values, MDF values, t-test P-values, and accuracy values that would determine whether the classifier or biomarker is clinically significant. In another example, a classifier or biomarker is considered clinically significant if the P-value of the t-test was less than about 0.08, 0.07, 0.06, 0.05, 0.04, 0.03, 0.02, 0.01, 0.005, 0.004, 0.003, 0.002, or 0.001. In some instances, the P-value may be based on any of the following comparisons: BCR vs non-BCR, CP vs non-CP, PCSM vs non-PCSM. For example, a classifier or biomarker is determined to be clinically significant if the P-values of the differences between the KM curves for BCR vs non-BCR, CP vs non-CP, PCSM vs non-PCSM is lower than about 0.08, 0.07, 0.06, 0.05, 0.04, 0.03, 0.02, 0.01, 0.005, 0.004, 0.003, 0.002, or 0.001.

In some instances, the performance of the classifier or biomarker is based on the odds ratio. A classifier or biomarker may be considered to have good performance if the odds ratio is at least about 1.30, 1.31, 1.32, 1.33, 1.34, 1.35, 1.36, 1.37, 1.38, 1.39, 1.40, 1.41, 1.42, 1.43, 1.44, 1.45, 1.46, 1.47, 1.48, 1.49, 1.50, 1.52, 1.55, 1.57, 1.60, 1.62, 1.65, 1.67, 1.70 or more. In some instances, the odds ratio of a classifier or biomarker is at least about 1.33.

The clinical significance of the classifiers and/or biomarkers may be based on Univariable Analysis Odds Ratio P-value (uvaORPval). The Univariable Analysis Odds Ratio P-value (uvaORPval) of the classifier and/or biomarker may be between about 0-0.4. The Univariable Analysis Odds Ratio P-value (uvaORPval) of the classifier and/or biomarker may be between about 0-0.3. The Univariable Analysis Odds Ratio P-value (uvaORPval) of the classifier and/or biomarker may be between about 0-0.2. The Univariable Analysis Odds Ratio P-value (uvaORPval) of the classifier and/or biomarker may be less than or equal to 0.25, 0.22, 0.21, 0.20, 0.19, 0.18, 0.17, 0.16, 0.15, 0.14, 0.13, 0.12, 0.11. The Univariable Analysis Odds Ratio P-value (uvaORPval) of the classifier and/or biomarker may be less than or equal to 0.10, 0.09, 0.08, 0.07, 0.06, 0.05, 0.04, 0.03, 0.02, 0.01. The Univariable Analysis Odds Ratio P-value (uvaORPval) of the classifier and/or biomarker may be less than or equal to 0.009, 0.008, 0.007, 0.006, 0.005, 0.004, 0.003, 0.002, 0.001.

The clinical significance of the classifiers and/or biomarkers may be based on multivariable analysis Odds Ratio P-value (mvaORPval). The multivariable analysis Odds Ratio P-value (mvaORPval) of the classifier and/or biomarker may be between about 0-1. The multivariable analysis Odds Ratio P-value (mvaORPval) of the classifier and/or biomarker may be between about 0-0.9. The multivariable analysis Odds Ratio P-value (mvaORPval) of the classifier and/or biomarker may be between about 0-0.8. The multivariable analysis Odds Ratio P-value (mvaORPval) of the classifier and/or biomarker may be less than or equal to 0.90, 0.88, 0.86, 0.84, 0.82, 0.80. The multivariable analysis Odds Ratio P-value (mvaORPval) of the classifier and/or biomarker may be less than or equal to 0.78, 0.76, 0.74, 0.72, 0.70, 0.68, 0.66, 0.64, 0.62, 0.60, 0.58, 0.56, 0.54, 0.52, 0.50. The multivariable analysis Odds Ratio P-value (mvaORPval) of the classifier and/or biomarker may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The multivariable analysis Odds Ratio P-value (mvaORPval) of the classifier and/or biomarker may be less than or equal to 0.10, 0.09, 0.08, 0.07, 0.06, 0.05, 0.04, 0.03, 0.02, 0.01. The multivariable analysis Odds Ratio P-value (mvaORPval) of the classifier and/or biomarker may be less than or equal to 0.009, 0.008, 0.007, 0.006, 0.005, 0.004, 0.003, 0.002, 0.001.

The clinical significance of the classifiers and/or biomarkers may be based on the Kaplan Meier P-value (KM P-value). The Kaplan Meier P-value (KM P-value) of the classifier and/or biomarker may be between about 0-0.8. The Kaplan Meier P-value (KM P-value) of the classifier and/or biomarker may be between about 0-0.7. The Kaplan Meier P-value (KM P-value) of the classifier and/or biomarker may be less than or equal to 0.80, 0.78, 0.76, 0.74, 0.72, 0.70, 0.68, 0.66, 0.64, 0.62, 0.60, 0.58, 0.56, 0.54, 0.52, 0.50. The Kaplan Meier P-value (KM P-value) of the classifier and/or biomarker may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The Kaplan Meier P-value (KM P-value) of the classifier and/or biomarker may be less than or equal to 0.10, 0.09, 0.08, 0.07, 0.06, 0.05, 0.04, 0.03, 0.02, 0.01. The Kaplan Meier P-value (KM P-value) of the classifier and/or biomarker may be less than or equal to 0.009, 0.008, 0.007, 0.006, 0.005, 0.004, 0.003, 0.002, 0.001.

The clinical significance of the classifiers and/or biomarkers may be based on the survival AUC value (survAUC). The survival AUC value (survAUC) of the classifier and/or biomarker may be between about 0-1. The survival AUC value (survAUC) of the classifier and/or biomarker may be between about 0-0.9. The survival AUC value (survAUC) of the classifier and/or biomarker may be less than or equal to 1, 0.98, 0.96, 0.94, 0.92, 0.90, 0.88, 0.86, 0.84, 0.82, 0.80. The survival AUC value (survAUC) of the classifier and/or biomarker may be less than or equal to 0.80, 0.78, 0.76, 0.74, 0.72, 0.70, 0.68, 0.66, 0.64, 0.62, 0.60, 0.58, 0.56, 0.54, 0.52, 0.50. The survival AUC value (survAUC) of the classifier and/or biomarker may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The survival AUC value (survAUC) of the classifier and/or biomarker may be less than or equal to 0.10, 0.09, 0.08, 0.07, 0.06, 0.05, 0.04, 0.03, 0.02, 0.01. The survival AUC value (survAUC) of the classifier and/or biomarker may be less than or equal to 0.009, 0.008, 0.007, 0.006, 0.005, 0.004, 0.003, 0.002, 0.001.

The clinical significance of the classifiers and/or biomarkers may be based on the Univariable Analysis Hazard Ratio P-value (uvaHRPval). The Univariable Analysis Hazard Ratio P-value (uvaHRPval) of the classifier and/or biomarker may be between about 0-0.4. The Univariable Analysis Hazard Ratio P-value (uvaHRPval) of the classifier and/or biomarker may be between about 0-0.3. The Univariable Analysis Hazard Ratio P-value (uvaHRPval) of the classifier and/or biomarker may be less than or equal to 0.40, 0.38, 0.36, 0.34, 0.32. The Univariable Analysis Hazard Ratio P-value (uvaHRPval) of the classifier and/or biomarker may be less than or equal to 0.30, 0.29, 0.28, 0.27, 0.26, 0.25, 0.24, 0.23, 0.22, 0.21, 0.20. The Univariable Analysis Hazard Ratio P-value (uvaHRPval) of the classifier and/or biomarker may be less than or equal to 0.19, 0.18, 0.17, 0.16, 0.15, 0.14, 0.13, 0.12, 0.11. The Univariable Analysis Hazard Ratio P-value (uvaHRPval) of the classifier and/or biomarker may be less than or equal to 0.10, 0.09, 0.08, 0.07, 0.06, 0.05, 0.04, 0.03, 0.02, 0.01. The Univariable Analysis Hazard Ratio P-value (uvaHRPval) of the classifier and/or biomarker may be less than or equal to 0.009, 0.008, 0.007, 0.006, 0.005, 0.004, 0.003, 0.002, 0.001.

The clinical significance of the classifiers and/or biomarkers may be based on the Multivariable Analysis Hazard Ratio P-value (mvaHRPval)mva HRPval. The Multivariable Analysis Hazard Ratio P-value (mvaHRPval)mva HRPval of the classifier and/or biomarker may be between about 0-1. The Multivariable Analysis Hazard Ratio P-value (mvaHRPval)mva HRPval of the classifier and/or biomarker may be between about 0-0.9. The Multivariable Analysis Hazard Ratio P-value (mvaHRPval)mva HRPval of the classifier and/or biomarker may be less than or equal to 1, 0.98, 0.96, 0.94, 0.92, 0.90, 0.88, 0.86, 0.84, 0.82, 0.80. The Multivariable Analysis Hazard Ratio P-value (mvaHRPval)mva HRPval of the classifier and/or biomarker may be less than or equal to 0.80, 0.78, 0.76, 0.74, 0.72, 0.70, 0.68, 0.66, 0.64, 0.62, 0.60, 0.58, 0.56, 0.54, 0.52, 0.50. The Multivariable Analysis Hazard Ratio P-value (mvaHRPval)mva HRPval of the classifier and/or biomarker may be less than or equal to 0.48, 0.46, 0.44, 0.42, 0.40, 0.38, 0.36, 0.34, 0.32, 0.30, 0.28, 0.26, 0.25, 0.22, 0.21, 0.20, 0.19, 0.18, 0.17, 0.16, 0.15, 0.14, 0.13, 0.12, 0.11. The Multivariable Analysis Hazard Ratio P-value (mvaHRPval)mva HRPval of the classifier and/or biomarker may be less than or equal to 0.10, 0.09, 0.08, 0.07, 0.06, 0.05, 0.04, 0.03, 0.02, 0.01. The Multivariable Analysis Hazard Ratio P-value (mvaHRPval)mva HRPval of the classifier and/or biomarker may be less than or equal to 0.009, 0.008, 0.007, 0.006, 0.005, 0.004, 0.003, 0.002, 0.001.

The clinical significance of the classifiers and/or biomarkers may be based on the Multivariable Analysis Hazard Ratio P-value (mvaHRPval). The Multivariable Analysis Hazard Ratio P-value (mvaHRPval) of the classifier and/or biomarker may be between about 0 to about 0.60. significance of the classifier and/or biomarker may be based on the Multivariable Analysis Hazard Ratio P-value (mvaHRPval). The Multivariable Analysis Hazard Ratio P-value (mvaHRPval) of the classifier and/or biomarker may be between about 0 to about 0.50. significance of the classifier and/or biomarker may be based on the Multivariable Analysis Hazard Ratio P-value (mvaHRPval). The Multivariable Analysis Hazard Ratio P-value (mvaHRPval) of the classifier and/or biomarker may be less than or equal to 0.50, 0.47, 0.45, 0.43, 0.40, 0.38, 0.35, 0.33, 0.30, 0.28, 0.25, 0.22, 0.20, 0.18, 0.16, 0.15, 0.14, 0.13, 0.12, 0.11, 0.10. The Multivariable Analysis Hazard Ratio P-value (mvaHRPval) of the classifier and/or biomarker may be less than or equal to 0.10, 0.09, 0.08, 0.07, 0.06, 0.05, 0.04, 0.03, 0.02, 0.01. The Multivariable Analysis Hazard Ratio P-value (mvaHRPval) of the classifier and/or biomarker may be less than or equal to 0.01, 0.009, 0.008, 0.007, 0.006, 0.005, 0.004, 0.003, 0.002, 0.001.

The classifiers and/or biomarkers disclosed herein may outperform current classifiers or clinical variables in providing clinically relevant analysis of a sample from a subject. In some instances, the classifiers or biomarkers may more accurately predict a clinical outcome or status as compared to current classifiers or clinical variables. For example, a classifier or biomarker may more accurately predict metastatic disease. Alternatively, a classifier or biomarker may more accurately predict no evidence of disease. In some instances, the classifier or biomarker may more accurately predict death from a disease. The performance of a classifier or biomarker disclosed herein may be based on the AUC value, odds ratio, 95% CI, difference in range of the 95% CI, p-value or any combination thereof.

The performance of the classifiers and/or biomarkers disclosed herein may be determined by AUC values and an improvement in performance may be determined by the difference in the AUC value of the classifier or biomarker disclosed herein and the AUC value of current classifiers or clinical variables. In some instances, a classifier and/or biomarker disclosed herein outperforms current classifiers or clinical variables when the AUC value of the classifier and/or or biomarker disclosed herein is greater than the AUC value of the current classifiers or clinical variables by at least about 0.05, 0.06, 0.07, 0.08, 0.09, 0.10, 0.11, 0.12, 0.13, 0.14, 0.15, 0.16, 0.17, 0.18, 0.19, 0.20, 0.022, 0.25, 0.27, 0.30, 0.32, 0.35, 0.37, 0.40, 0.42, 0.45, 0.47, 0.50 or more. In some instances, the AUC value of the classifier and/or or biomarker disclosed herein is greater than the AUC value of the current classifiers or clinical variables by at least about 0.10. In some instances, the AUC value of the classifier and/or or biomarker disclosed herein is greater than the AUC value of the current classifiers or clinical variables by at least about 0.13. In some instances, the AUC value of the classifier and/or or biomarker disclosed herein is greater than the AUC value of the current classifiers or clinical variables by at least about 0.18.

The performance of the classifiers and/or biomarkers disclosed herein may be determined by the odds ratios and an improvement in performance may be determined by comparing the odds ratio of the classifier or biomarker disclosed herein and the odds ratio of current classifiers or clinical variables. Comparison of the performance of two or more classifiers, biomarkers, and/or clinical variables can be generally be based on the comparison of the absolute value of (1-odds ratio) of a first classifier, biomarker or clinical variable to the absolute value of (1-odds ratio) of a second classifier, biomarker or clinical variable. Generally, the classifier, biomarker or clinical variable with the greater absolute value of (1-odds ratio) can be considered to have better performance as compared to the classifier, biomarker or clinical variable with a smaller absolute value of (1-odds ratio).

In some instances, the performance of a classifier, biomarker or clinical variable is based on the comparison of the odds ratio and the 95% confidence interval (CI). For example, a first classifier, biomarker or clinical variable may have a greater absolute value of (1-odds ratio) than a second classifier, biomarker or clinical variable, however, the 95% CI of the first classifier, biomarker or clinical variable may overlap 1 (e.g., poor accuracy), whereas the 95% CI of the second classifier, biomarker or clinical variable does not overlap 1. In this instance, the second classifier, biomarker or clinical variable is considered to outperform the first classifier, biomarker or clinical variable because the accuracy of the first classifier, biomarker or clinical variable is less than the accuracy of the second classifier, biomarker or clinical variable. In another example, a first classifier, biomarker or clinical variable may outperform a second classifier, biomarker or clinical variable based on a comparison of the odds ratio; however, the difference in the 95% CI of the first classifier, biomarker or clinical variable is at least about 2 times greater than the 95% CI of the second classifier, biomarker or clinical variable. In this instance, the second classifier, biomarker or clinical variable is considered to outperform the first classifier.

In some instances, a classifier or biomarker disclosed herein more accurate than a current classifier or clinical variable. The classifier or biomarker disclosed herein is more accurate than a current classifier or clinical variable if the range of 95% CI of the classifier or biomarker disclosed herein does not span or overlap 1 and the range of the 95% CI of the current classifier or clinical variable spans or overlaps 1.

In some instances, a classifier or biomarker disclosed herein more accurate than a current classifier or clinical variable. The classifier or biomarker disclosed herein is more accurate than a current classifier or clinical variable when difference in range of the 95% CI of the classifier or biomarker disclosed herein is about 0.70, 0.60, 0.50, 0.40, 0.30, 0.20, 0.15, 0.14, 0.13, 0.12, 0.10, 0.09, 0.08, 0.07, 0.06, 0.05, 0.04, 0.03, 0.02 times less than the difference in range of the 95% CI of the current classifier or clinical variable. The classifier or biomarker disclosed herein is more accurate than a current classifier or clinical variable when difference in range of the 95% CI of the classifier or biomarker disclosed herein between about 0.20 to about 0.04 times less than the difference in range of the 95% CI of the current classifier or clinical variable.

In some instances, the methods disclosed herein may comprise the use of a genomic classifier (GC) model. A general method for developing a GC model may comprise (a) providing a sample from a subject suffering from a cancer; (b) assaying the expression level for a plurality of targets; (c) generating a model by using a machine learning algorithm. In some instances, the machine learning algorithm comprises Random Forests. In another example, a GC model may developed by using a machine learning algorithm to analyze and rank genomic features. Analyzing the genomic features may comprise classifying one or more genomic features. The method may further comprise validating the classifier and/or refining the classifier by using a machine learning algorithm.

The methods disclosed herein may comprise generating one or more clinical classifiers (CC). The clinical classifier can be developed using one or more clinicopathologic variables. The clinicopathologic variables may be selected from the group comprising Lymph node invasion status (LNI); Surgical Margin Status (SMS); Seminal Vesicle Invasion (SVI); Extra Capsular Extension (ECE); Pathological Gleason Score; and the pre-operative PSA. The method may comprise using one or more of the clinicopathologic variables as binary variables. Alternatively, or additionally, the one or more clinicopathologic variables may be converted to a logarithmic value (e.g., log 10). The method may further comprise assembling the variables in a logistic regression. In some instances, the CC is combined with the GC to produce a genomic clinical classifier (GCC).

In some instances, the methods disclosed herein may comprise the use of a genomic-clinical classifier (GCC) model. A general method for developing a GCC model may comprise (a) providing a sample from a subject suffering from a cancer; (b) assaying the expression level for a plurality of targets; (c) generating a model by using a machine learning algorithm. In some instances, the machine learning algorithm comprises Random Forests.

Cancer

The systems, compositions and methods disclosed herein may be used to diagnosis, monitor and/or predict the status or outcome of a cancer. Generally, a cancer is characterized by the uncontrolled growth of abnormal cells anywhere in a body. The abnormal cells may be termed cancer cells, malignant cells, or tumor cells. Many cancers and the abnormal cells that compose the cancer tissue are further identified by the name of the tissue that the abnormal cells originated from (for example, breast cancer, lung cancer, colon cancer, prostate cancer, pancreatic cancer, thyroid cancer). Cancer is not confined to humans; animals and other living organisms can get cancer.

In some instances, the cancer may be malignant. Alternatively, the cancer may be benign. The cancer may be a recurrent and/or refractory cancer. Most cancers can be classified as a carcinoma, sarcoma, leukemia, lymphoma, myeloma, or a central nervous system cancer.

The cancer may be a sarcoma. Sarcomas are cancers of the bone, cartilage, fat, muscle, blood vessels, or other connective or supportive tissue. Sarcomas include, but are not limited to, bone cancer, fibrosarcoma, chondrosarcoma, Ewing's sarcoma, malignant hemangioendothelioma, malignant schwannoma, bilateral vestibular schwannoma, osteosarcoma, soft tissue sarcomas (e.g. alveolar soft part. sarcoma, angiosarcoma, cystosarcoma phylloides, dermatofibrosarcoma, desmoid tumor, epithelioid sarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, and synovial sarcoma).

Alternatively, the cancer may be a carcinoma. Carcinomas are cancers that begin in the epithelial cells, which are cells that cover the surface of the body, produce hormones, and make up glands. By way of non-limiting example, carcinomas include breast cancer, pancreatic cancer, lung cancer, colon cancer, colorectal cancer, rectal cancer, kidney cancer, bladder cancer, stomach cancer, prostate cancer, liver cancer, ovarian cancer, brain cancer, vaginal cancer, vulvar cancer, uterine cancer, oral cancer, penic cancer, testicular cancer, esophageal cancer, skin cancer, cancer of the fallopian tubes, head and neck cancer, gastrointestinal stromal cancer, adenocarcinoma, cutaneous or intraocular melanoma, cancer of the anal region, cancer of the small intestine, cancer of the endocrine system, cancer of the thyroid gland, cancer of the parathyroid gland, cancer of the adrenal gland, cancer of the urethra, cancer of the renal pelvis, cancer of the ureter, cancer of the endometrium, cancer of the cervix, cancer of the pituitary gland, neoplasms of the central nervous system (CNS), primary CNS lymphoma, brain stem glioma, and spinal axis tumors. In some instances, the cancer is a skin cancer, such as a basal cell carcinoma, squamous, melanoma, nonmelanoma, or actinic (solar) keratosis. Preferably, the cancer is a prostate cancer. Alternatively, the cancer may be a thyroid cancer, bladder cancer, or pancreatic cancer.

In some instances, the cancer is a lung cancer. Lung cancer can start in the airways that branch off the trachea to supply the lungs (bronchi) or the small air sacs of the lung (the alveoli). Lung cancers include non-small cell lung carcinoma (NSCLC), small cell lung carcinoma, and mesotheliomia. Examples of NSCLC include squamous cell carcinoma, adenocarcinoma, and large cell carcinoma. The mesothelioma may be a cancerous tumor of the lining of the lung and chest cavity (pleura) or lining of the abdomen (peritoneum). The mesothelioma may be due to asbestos exposure. The cancer may be a brain cancer, such as a glioblastoma.

Alternatively, the cancer may be a central nervous system (CNS) tumor. CNS tumors may be classified as gliomas or nongliomas. The glioma may be malignant glioma, high grade glioma, diffuse intrinsic pontine glioma. Examples of gliomas include astrocytomas, oligodendrogliomas (or mixtures of oligodendroglioma and astocytoma elements), and ependymomas. Astrocytomas include, but are not limited to, low-grade astrocytomas, anaplastic astrocytomas, glioblastoma multiforme, pilocytic astrocytoma, pleomorphic xanthoastrocytoma, and subependymal giant cell astrocytoma. Oligodendrogliomas include low-grade oligodendrogliomas (or oligoastrocytomas) and anaplastic oligodendriogliomas. Nongliomas include meningiomas, pituitary adenomas, primary CNS lymphomas, and medulloblastomas. In some instances, the cancer is a meningioma.

The cancer may be a leukemia. The leukemia may be an acute lymphocytic leukemia, acute myelocytic leukemia, chronic lymphocytic leukemia, or chronic myelocytic leukemia. Additional types of leukemias include hairy cell leukemia, chronic myelomonocytic leukemia, and juvenile myelomonocytic-leukemia.

In some instances, the cancer is a lymphoma. Lymphomas are cancers of the lymphocytes and may develop from either B or T lymphocytes. The two major types of lymphoma are Hodgkin's lymphoma, previously known as Hodgkin's disease, and non-Hodgkin's lymphoma. Hodgkin's lymphoma is marked by the presence of the Reed-Sternberg cell. Non-Hodgkin's lymphomas are all lymphomas which are not Hodgkin's lymphoma. Non-Hodgkin lymphomas may be indolent lymphomas and aggressive lymphomas. Non-Hodgkin's lymphomas include, but are not limited to, diffuse large B cell lymphoma, follicular lymphoma, mucosa-associated lymphatic tissue lymphoma (MALT), small cell lymphocytic lymphoma, mantle cell lymphoma, Burkitt's lymphoma, mediastinal large B cell lymphoma, Waldenström macroglobulinemia, nodal marginal zone B cell lymphoma (NMZL), splenic marginal zone lymphoma (SMZL), extranodal marginal zone B cell lymphoma, intravascular large B cell lymphoma, primary effusion lymphoma, and lymphomatoid granulomatosis.

Cancer Staging

Diagnosing, predicting, or monitoring a status or outcome of a cancer may comprise determining the stage of the cancer. Generally, the stage of a cancer is a description (usually numbers I to IV with IV having more progression) of the extent the cancer has spread. The stage often takes into account the size of a tumor, how deeply it has penetrated, whether it has invaded adjacent organs, how many lymph nodes it has metastasized to (if any), and whether it has spread to distant organs. Staging of cancer can be used as a predictor of survival, and cancer treatment may be determined by staging. Determining the stage of the cancer may occur before, during, or after treatment. The stage of the cancer may also be determined at the time of diagnosis.

Cancer staging can be divided into a clinical stage and a pathologic stage. Cancer staging may comprise the TNM classification. Generally, the TNM Classification of Malignant Tumours (TNM) is a cancer staging system that describes the extent of cancer in a patient's body. T may describe the size of the tumor and whether it has invaded nearby tissue, N may describe regional lymph nodes that are involved, and M may describe distant metastasis (spread of cancer from one body part to another). In the TNM (Tumor, Node, Metastasis) system, clinical stage and pathologic stage are denoted by a small "c" or "p" before the stage (e.g., cT3N1M0 or pT2N0).

Often, clinical stage and pathologic stage may differ. Clinical stage may be based on all of the available information obtained before a surgery to remove the tumor. Thus, it may include information about the tumor obtained by physical examination, radiologic examination, and endoscopy. Pathologic stage can add additional information gained by examination of the tumor microscopically by a pathologist. Pathologic staging can allow direct examination of the tumor and its spread, contrasted with clinical staging which may be limited by the fact that the information is obtained by making indirect observations at a tumor which is still in the body. The TNM staging system can be used for most forms of cancer.

Alternatively, staging may comprise Ann Arbor staging. Generally, Ann Arbor staging is the staging system for lymphomas, both in Hodgkin's lymphoma (previously called Hodgkin's disease) and Non-Hodgkin lymphoma (abbreviated NHL). The stage may depend on both the place where the malignant tissue is located (as located with biopsy, CT scanning and increasingly positron emission tomography) and on systemic symptoms due to the lymphoma ("B symptoms": night sweats, weight loss of >10% or fevers). The principal stage may be determined by location of the tumor. Stage I may indicate that the cancer is located in a single region, usually one lymph node and the surrounding area. Stage I often may not have outward symptoms. Stage II can indicate that the cancer is located in two separate regions, an affected lymph node or organ and a second affected area, and that both affected areas are confined to one side of the diaphragm—that is, both are above the diaphragm, or both are below the diaphragm. Stage III often indicates that the cancer has spread to both sides of the diaphragm, including one organ or area near the lymph nodes or the spleen. Stage IV may indicate diffuse or disseminated involvement of one or more extralymphatic organs, including any involvement of the liver, bone marrow, or nodular involvement of the lungs.

Modifiers may also be appended to some stages. For example, the letters A, B, E, X, or S can be appended to some stages. Generally, A or B may indicate the absence of constitutional (B-type) symptoms is denoted by adding an "A" to the stage; the presence is denoted by adding a "B" to the stage. E can be used if the disease is "extranodal" (not in the lymph nodes) or has spread from lymph nodes to adjacent tissue. X is often used if the largest deposit is >10 cm large ("bulky disease"), or whether the mediastinum is wider than ⅓ of the chest on a chest X-ray. S may be used if the disease has spread to the spleen.

The nature of the staging may be expressed with CS or PS. CS may denote that the clinical stage as obtained by doctor's examinations and tests. PS may denote that the pathological stage as obtained by exploratory laparotomy (surgery performed through an abdominal incision) with splenectomy (surgical removal of the spleen).

Therapeutic Regimens

Diagnosing, predicting, or monitoring a status or outcome of a cancer may comprise treating a cancer or preventing a cancer progression. In addition, diagnosing, predicting, or monitoring a status or outcome of a cancer may comprise identifying or predicting responders to an anti-cancer therapy. In some instances, diagnosing, predicting, or monitoring may comprise determining a therapeutic regimen. Determining a therapeutic regimen may comprise administering an anti-cancer therapy. Alternatively, determining a therapeutic regimen may comprise modifying, recommending, continuing or discontinuing an anti-cancer regimen. In some instances, if the sample expression patterns are consistent with the expression pattern for a known disease or disease outcome, the expression patterns can be used to designate one or more treatment modalities (e.g., therapeutic regimens, anti-cancer regimen). An anti-cancer regimen may comprise one or more anti-cancer therapies. Examples of anti-cancer therapies include surgery, chemotherapy, radiation therapy, immunotherapy/biological therapy, photodynamic therapy.

Surgical oncology uses surgical methods to diagnose, stage, and treat cancer, and to relieve certain cancer-related symptoms. Surgery may be used to remove the tumor (e.g., excisions, resections, debulking surgery), reconstruct a part of the body (e.g., restorative surgery), and/or to relieve symptoms such as pain (e.g., palliative surgery). Surgery may also include cryosurgery. Cryosurgery (also called cryotherapy) may use extreme cold produced by liquid nitrogen (or argon gas) to destroy abnormal tissue. Cryosurgery can be used to treat external tumors, such as those on the skin. For external tumors, liquid nitrogen can be applied directly to the cancer cells with a cotton swab or spraying device. Cryosurgery may also be used to treat tumors inside the body (internal tumors and tumors in the bone). For internal tumors, liquid nitrogen or argon gas may be circulated through a hollow instrument called a cryoprobe, which is placed in contact with the tumor. An ultrasound or MRI may be used to guide the cryoprobe and monitor the freezing of the cells, thus limiting damage to nearby healthy tissue. A ball of ice crystals may form around the probe, freezing nearby cells. Sometimes more than one probe is used to deliver the liquid nitrogen to various parts of the tumor. The probes may be put into the tumor during surgery or through the skin (percutaneously). After cryosurgery, the frozen tissue thaws and may be naturally absorbed by the body (for internal tumors), or may dissolve and form a scab (for external tumors).

Chemotherapeutic agents may also be used for the treatment of cancer. Examples of chemotherapeutic agents include alkylating agents, anti-metabolites, plant alkaloids and terpenoids, *vinca* alkaloids, podophyllotoxin, taxanes, topoisomerase inhibitors, and cytotoxic antibiotics. Cisplatin, carboplatin, and oxaliplatin are examples of alkylating agents. Other alkylating agents include mechlorethamine, cyclophosphamide, chlorambucil, ifosfamide. Alkylating agents may impair cell function by forming covalent bonds with the amino, carboxyl, sulfhydryl, and phosphate groups in biologically important molecules. Alternatively, alkylating agents may chemically modify a cell's DNA.

Anti-metabolites are another example of chemotherapeutic agents. Anti-metabolites may masquerade as purines or pyrimidines and may prevent purines and pyrimidines from becoming incorporated in to DNA during the "S" phase (of the cell cycle), thereby stopping normal development and division. Antimetabolites may also affect RNA synthesis. Examples of metabolites include azathioprine and mercaptopurine.

Alkaloids may be derived from plants and block cell division may also be used for the treatment of cancer. Alkyloids may prevent microtubule function. Examples of alkaloids are *vinca* alkaloids and taxanes. *Vinca* alkaloids may bind to specific sites on tubulin and inhibit the assembly of tubulin into microtubules (M phase of the cell cycle). The *vinca* alkaloids may be derived from the Madagascar periwinkle, *Catharanthus roseus* (formerly known as *Vinca rosea*). Examples of *vinca* alkaloids include, but are not limited to, vincristine, vinblastine, vinorelbine, or vindesine. Taxanes are diterpenes produced by the plants of the genus *Taxus* (yews). Taxanes may be derived from natural sources or synthesized artificially. Taxanes include paclitaxel (Taxol) and docetaxel (Taxotere). Taxanes may disrupt microtubule function. Microtubules are essential to cell division, and taxanes may stabilize GDP-bound tubulin in the microtubule, thereby inhibiting the process of cell division. Thus, in essence, taxanes may be mitotic inhibitors. Taxanes may also be radiosensitizing and often contain numerous chiral centers.

Alternative chemotherapeutic agents include podophyllotoxin. Podophyllotoxin is a plant-derived compound that may help with digestion and may be used to produce cytostatic drugs such as etoposide and teniposide. They may prevent the cell from entering the G1 phase (the start of DNA replication) and the replication of DNA (the S phase).

Topoisomerases are essential enzymes that maintain the topology of DNA. Inhibition of type I or type II topoisomerases may interfere with both transcription and replication of DNA by upsetting proper DNA supercoiling. Some chemotherapeutic agents may inhibit topoisomerases. For example, some type I topoisomerase inhibitors include camptothecins: irinotecan and topotecan. Examples of type II inhibitors include amsacrine, etoposide, etoposide phosphate, and teniposide.

Another example of chemotherapeutic agents is cytotoxic antibiotics. Cytotoxic antibiotics are a group of antibiotics that are used for the treatment of cancer because they may interfere with DNA replication and/or protein synthesis. Cytotoxic antibiotics include, but are not limited to, actinomycin, anthracyclines, doxorubicin, daunorubicin, valrubicin, idarubicin, epirubicin, bleomycin, plicamycin, and mitomycin.

In some instances, the anti-cancer treatment may comprise radiation therapy. Radiation can come from a machine outside the body (external-beam radiation therapy) or from radioactive material placed in the body near cancer cells (internal radiation therapy, more commonly called brachytherapy). Systemic radiation therapy uses a radioactive substance, given by mouth or into a vein that travels in the blood to tissues throughout the body.

External-beam radiation therapy may be delivered in the form of photon beams (either x-rays or gamma rays). A photon is the basic unit of light and other forms of electromagnetic radiation. An example of external-beam radiation therapy is called 3-dimensional conformal radiation therapy (3D-CRT). 3D-CRT may use computer software and advanced treatment machines to deliver radiation to very precisely shaped target areas. Many other methods of external-beam radiation therapy are currently being tested and used in cancer treatment. These methods include, but are not limited to, intensity-modulated radiation therapy (IMRT), image-guided radiation therapy (IGRT), Stereotactic radiosurgery (SRS), Stereotactic body radiation therapy (SBRT), and proton therapy.

Intensity-modulated radiation therapy (IMRT) is an example of external-beam radiation and may use hundreds of tiny radiation beam-shaping devices, called collimators, to deliver a single dose of radiation. The collimators can be stationary or can move during treatment, allowing the intensity of the radiation beams to change during treatment sessions. This kind of dose modulation allows different areas of a tumor or nearby tissues to receive different doses of radiation. IMRT is planned in reverse (called inverse treatment planning). In inverse treatment planning, the radiation doses to different areas of the tumor and surrounding tissue are planned in advance, and then a high-powered computer program calculates the required number of beams and angles of the radiation treatment. In contrast, during traditional (forward) treatment planning, the number and angles of the radiation beams are chosen in advance and computers calculate how much dose may be delivered from each of the planned beams. The goal of IMRT is to increase the radiation dose to the areas that need it and reduce radiation exposure to specific sensitive areas of surrounding normal tissue.

Another example of external-beam radiation is image-guided radiation therapy (IGRT). In IGRT, repeated imaging scans (CT, MRI, or PET) may be performed during treatment. These imaging scans may be processed by computers to identify changes in a tumor's size and location due to treatment and to allow the position of the patient or the planned radiation dose to be adjusted during treatment as needed. Repeated imaging can increase the accuracy of radiation treatment and may allow reductions in the planned volume of tissue to be treated, thereby decreasing the total radiation dose to normal tissue.

Tomotherapy is a type of image-guided IMRT. A tomotherapy machine is a hybrid between a CT imaging scanner and an external-beam radiation therapy machine. The part of the tomotherapy machine that delivers radiation for both imaging and treatment can rotate completely around the patient in the same manner as a normal CT scanner. Tomotherapy machines can capture CT images of the patient's tumor immediately before treatment sessions, to allow for very precise tumor targeting and sparing of normal tissue.

Stereotactic radiosurgery (SRS) can deliver one or more high doses of radiation to a small tumor. SRS uses extremely accurate image-guided tumor targeting and patient positioning. Therefore, a high dose of radiation can be given without excess damage to normal tissue. SRS can be used to treat small tumors with well-defined edges. It is most commonly used in the treatment of brain or spinal tumors and brain metastases from other cancer types. For the treatment of some brain metastases, patients may receive radiation therapy to the entire brain (called whole-brain radiation therapy) in addition to SRS. SRS requires the use of a head frame or other device to immobilize the patient during treatment to ensure that the high dose of radiation is delivered accurately.

Stereotactic body radiation therapy (SBRT) delivers radiation therapy in fewer sessions, using smaller radiation fields and higher doses than 3D-CRT in most cases. SBRT may treat tumors that lie outside the brain and spinal cord. Because these tumors are more likely to move with the normal motion of the body, and therefore cannot be targeted as accurately as tumors within the brain or spine, SBRT is usually given in more than one dose. SBRT can be used to treat small, isolated tumors, including cancers in the lung and liver. SBRT systems may be known by their brand names, such as the CyberKnife®.

In proton therapy, external-beam radiation therapy may be delivered by proton. Protons are a type of charged particle. Proton beams differ from photon beams mainly in the way they deposit energy in living tissue. Whereas photons deposit energy in small packets all along their path through tissue, protons deposit much of their energy at the end of their path (called the Bragg peak) and deposit less energy along the way. Use of protons may reduce the exposure of normal tissue to radiation, possibly allowing the delivery of higher doses of radiation to a tumor.

Other charged particle beams such as electron beams may be used to irradiate superficial tumors, such as skin cancer or tumors near the surface of the body, but they cannot travel very far through tissue.

Internal radiation therapy (brachytherapy) is radiation delivered from radiation sources (radioactive materials) placed inside or on the body. Several brachytherapy techniques are used in cancer treatment. Interstitial brachytherapy may use a radiation source placed within tumor tissue, such as within a prostate tumor. Intracavitary brachytherapy may use a source placed within a surgical cavity or a body cavity, such as the chest cavity, near a tumor. Episcleral brachytherapy, which may be used to treat melanoma inside the eye, may use a source that is attached to the eye. In brachytherapy, radioactive isotopes can be sealed in tiny pellets or "seeds." These seeds may be placed in patients using delivery devices, such as needles, catheters, or some other type of carrier. As the isotopes decay naturally, they give off radiation that may damage nearby cancer cells. Brachytherapy may be able to deliver higher doses of radiation to some cancers than external-beam radiation therapy while causing less damage to normal tissue.

Brachytherapy can be given as a low-dose-rate or a high-dose-rate treatment. In low-dose-rate treatment, cancer cells receive continuous low-dose radiation from the source over a period of several days. In high-dose-rate treatment, a robotic machine attached to delivery tubes placed inside the body may guide one or more radioactive sources into or near a tumor, and then removes the sources at the end of each treatment session. High-dose-rate treatment can be given in one or more treatment sessions. An example of a high-dose-rate treatment is the MammoSite® system. Bracytherapy may be used to treat patients with breast cancer who have undergone breast-conserving surgery.

The placement of brachytherapy sources can be temporary or permanent. For permanent brachytherapy, the sources may be surgically sealed within the body and left there, even after all of the radiation has been given off. In some instances, the remaining material (in which the radioactive isotopes were sealed) does not cause any discomfort or harm to the patient. Permanent brachytherapy is a type of low-dose-rate brachytherapy. For temporary brachytherapy, tubes (catheters) or other carriers are used to deliver the radiation sources, and both the carriers and the radiation sources are removed after treatment. Temporary brachytherapy can be either low-dose-rate or high-dose-rate treatment. Brachytherapy may be used alone or in addition to external-beam radiation therapy to provide a "boost" of radiation to a tumor while sparing surrounding normal tissue.

In systemic radiation therapy, a patient may swallow or receive an injection of a radioactive substance, such as radioactive iodine or a radioactive substance bound to a monoclonal antibody. Radioactive iodine (131I) is a type of systemic radiation therapy commonly used to help treat cancer, such as thyroid cancer. Thyroid cells naturally take up radioactive iodine. For systemic radiation therapy for some other types of cancer, a monoclonal antibody may help target the radioactive substance to the right place. The antibody joined to the radioactive substance travels through the blood, locating and killing tumor cells. For example, the drug ibritumomab tiuxetan (Zevalin®) may be used for the treatment of certain types of B-cell non-Hodgkin lymphoma (NHL). The antibody part of this drug recognizes and binds to a protein found on the surface of B lymphocytes. The combination drug regimen of tositumomab and iodine I 131 tositumomab (Bexxar®) may be used for the treatment of certain types of cancer, such as NHL. In this regimen, nonradioactive tositumomab antibodies may be given to patients first, followed by treatment with tositumomab antibodies that have 131I attached. Tositumomab may recognize and bind to the same protein on B lymphocytes as ibritumomab. The nonradioactive form of the antibody may help protect normal B lymphocytes from being damaged by radiation from 131I.

Some systemic radiation therapy drugs relieve pain from cancer that has spread to the bone (bone metastases). This is a type of palliative radiation therapy. The radioactive drugs samarium-153-lexidronam (Quadramet®) and strontium-89 chloride (Metastron®) are examples of radiopharmaceuticals may be used to treat pain from bone metastases.

Biological therapy (sometimes called immunotherapy, biotherapy, or biological response modifier (BRM) therapy) uses the body's immune system, either directly or indirectly, to fight cancer or to lessen the side effects that may be caused by some cancer treatments. Biological therapies include interferons, interleukins, colony-stimulating factors, monoclonal antibodies, vaccines, gene therapy, and nonspecific immunomodulating agents.

Interferons (IFNs) are types of cytokines that occur naturally in the body. Interferon alpha, interferon beta, and interferon gamma are examples of interferons that may be used in cancer treatment.

Like interferons, interleukins (ILs) are cytokines that occur naturally in the body and can be made in the laboratory. Many interleukins have been identified for the treatment of cancer. For example, interleukin-2 (IL-2 or aldesleukin), interleukin 7, and interleukin 12 have may be used as an anti-cancer treatment. IL-2 may stimulate the growth and activity of many immune cells, such as lymphocytes, that can destroy cancer cells. Interleukins may be used to treat a number of cancers, including leukemia, lymphoma, and brain, colorectal, ovarian, breast, kidney and prostate cancers.

Colony-stimulating factors (CSFs) (sometimes called hematopoietic growth factors) may also be used for the treatment of cancer. Some examples of CSFs include, but are not limited to, G-CSF (filgrastim) and GM-CSF (sargramostim). CSFs may promote the division of bone marrow stem cells and their development into white blood cells, platelets, and red blood cells. Bone marrow is critical to the body's immune system because it is the source of all blood cells. Because anticancer drugs can damage the body's ability to make white blood cells, red blood cells, and platelets, stimulation of the immune system by CSFs may benefit patients undergoing other anti-cancer treatment, thus CSFs may be combined with other anti-cancer therapies, such as chemotherapy. CSFs may be used to treat a large variety of cancers, including lymphoma, leukemia, multiple myeloma, melanoma, and cancers of the brain, lung, esophagus, breast, uterus, ovary, prostate, kidney, colon, and rectum.

Another type of biological therapy includes monoclonal antibodies (MOABs or MoABs). These antibodies may be produced by a single type of cell and may be specific for a particular antigen. To create MOABs, a human cancer cells may be injected into mice. In response, the mouse immune system can make antibodies against these cancer cells. The mouse plasma cells that produce antibodies may be isolated and fused with laboratory-grown cells to create "hybrid" cells called hybridomas. Hybridomas can indefinitely produce large quantities of these pure antibodies, or MOABs. MOABs may be used in cancer treatment in a number of ways. For instance, MOABs that react with specific types of cancer may enhance a patient's immune response to the cancer. MOABs can be programmed to act against cell growth factors, thus interfering with the growth of cancer cells.

MOABs may be linked to other anti-cancer therapies such as chemotherapeutics, radioisotopes (radioactive substances), other biological therapies, or other toxins. When the antibodies latch onto cancer cells, they deliver these anti-cancer therapies directly to the tumor, helping to destroy it. MOABs carrying radioisotopes may also prove useful in diagnosing certain cancers, such as colorectal, ovarian, and prostate.

Rituxan® (rituximab) and Herceptin® (trastuzumab) are examples of MOABs that may be used as a biological therapy. Rituxan may be used for the treatment of non-Hodgkin lymphoma. Herceptin can be used to treat metastatic breast cancer in patients with tumors that produce excess amounts of a protein called HER2. Alternatively, MOABs may be used to treat lymphoma, leukemia, melanoma, and cancers of the brain, breast, lung, kidney, colon, rectum, ovary, prostate, and other areas.

Cancer vaccines are another form of biological therapy. Cancer vaccines may be designed to encourage the patient's immune system to recognize cancer cells. Cancer vaccines may be designed to treat existing cancers (therapeutic vaccines) or to prevent the development of cancer (prophylactic vaccines). Therapeutic vaccines may be injected in a person after cancer is diagnosed. These vaccines may stop the growth of existing tumors, prevent cancer from recurring, or eliminate cancer cells not killed by prior treatments. Cancer vaccines given when the tumor is small may be able to eradicate the cancer. On the other hand, prophylactic vaccines are given to healthy individuals before cancer develops. These vaccines are designed to stimulate the immune system to attack viruses that can cause cancer. By targeting these cancer-causing viruses, development of certain cancers may be prevented. For example, cervarix and gardasil are vaccines to treat human papilloma virus and may prevent cervical cancer. Therapeutic vaccines may be used to treat melanoma, lymphoma, leukemia, and cancers of the brain, breast, lung, kidney, ovary, prostate, pancreas, colon, and rectum. Cancer vaccines can be used in combination with other anti-cancer therapies.

Gene therapy is another example of a biological therapy. Gene therapy may involve introducing genetic material into a person's cells to fight disease. Gene therapy methods may improve a patient's immune response to cancer. For example, a gene may be inserted into an immune cell to enhance its ability to recognize and attack cancer cells. In another approach, cancer cells may be injected with genes that cause the cancer cells to produce cytokines and stimulate the immune system.

In some instances, biological therapy includes nonspecific immunomodulating agents. Nonspecific immunomodulating agents are substances that stimulate or indirectly augment the immune system. Often, these agents target key immune system cells and may cause secondary responses such as increased production of cytokines and immunoglobulins. Two nonspecific immunomodulating agents used in cancer treatment are *bacillus* Calmette-Guerin (BCG) and levamisole. BCG may be used in the treatment of superficial bladder cancer following surgery. BCG may work by stimulating an inflammatory, and possibly an immune, response. A solution of BCG may be instilled in the bladder. Levamisole is sometimes used along with fluorouracil (5-FU) chemotherapy in the treatment of stage III (Dukes' C) colon cancer following surgery. Levamisole may act to restore depressed immune function.

Photodynamic therapy (PDT) is an anti-cancer treatment that may use a drug, called a photosensitizer or photosensitizing agent, and a particular type of light. When photosensitizers are exposed to a specific wavelength of light, they may produce a form of oxygen that kills nearby cells. A photosensitizer may be activated by light of a specific wavelength. This wavelength determines how far the light can travel into the body. Thus, photosensitizers and wavelengths of light may be used to treat different areas of the body with PDT.

In the first step of PDT for cancer treatment, a photosensitizing agent may be injected into the bloodstream. The agent may be absorbed by cells all over the body but may stay in cancer cells longer than it does in normal cells. Approximately 24 to 72 hours after injection, when most of the agent has left normal cells but remains in cancer cells, the tumor can be exposed to light. The photosensitizer in the tumor can absorb the light and produces an active form of oxygen that destroys nearby cancer cells. In addition to directly killing cancer cells, PDT may shrink or destroy tumors in two other ways. The photosensitizer can damage blood vessels in the tumor, thereby preventing the cancer from receiving necessary nutrients. PDT may also activate the immune system to attack the tumor cells.

The light used for PDT can come from a laser or other sources. Laser light can be directed through fiber optic cables (thin fibers that transmit light) to deliver light to areas inside the body. For example, a fiber optic cable can be inserted through an endoscope (a thin, lighted tube used to look at tissues inside the body) into the lungs or esophagus to treat cancer in these organs. Other light sources include light-emitting diodes (LEDs), which may be used for surface tumors, such as skin cancer. PDT is usually performed as an outpatient procedure. PDT may also be repeated and may be used with other therapies, such as surgery, radiation, or chemotherapy.

Extracorporeal photopheresis (ECP) is a type of PDT in which a machine may be used to collect the patient's blood cells. The patient's blood cells may be treated outside the body with a photosensitizing agent, exposed to light, and then returned to the patient. ECP may be used to help lessen the severity of skin symptoms of cutaneous T-cell lymphoma that has not responded to other therapies. ECP may be used to treat other blood cancers, and may also help reduce rejection after transplants.

Additionally, photosensitizing agent, such as porfimer sodium or Photofrin®, may be used in PDT to treat or relieve the symptoms of esophageal cancer and non-small cell lung cancer. Porfimer sodium may relieve symptoms of esophageal cancer when the cancer obstructs the esophagus or when the cancer cannot be satisfactorily treated with laser therapy alone. Porfimer sodium may be used to treat non-small cell lung cancer in patients for whom the usual treatments are not appropriate, and to relieve symptoms in patients with non-small cell lung cancer that obstructs the airways. Porfimer sodium may also be used for the treatment of precancerous lesions in patients with Barrett esophagus, a condition that can lead to esophageal cancer.

Laser therapy may use high-intensity light to treat cancer and other illnesses. Lasers can be used to shrink or destroy tumors or precancerous growths. Lasers are most commonly used to treat superficial cancers (cancers on the surface of the body or the lining of internal organs) such as basal cell skin cancer and the very early stages of some cancers, such as cervical, penile, vaginal, vulvar, and non-small cell lung cancer.

Lasers may also be used to relieve certain symptoms of cancer, such as bleeding or obstruction. For example, lasers can be used to shrink or destroy a tumor that is blocking a patient's trachea (windpipe) or esophagus. Lasers also can be used to remove colon polyps or tumors that are blocking the colon or stomach.

Laser therapy is often given through a flexible endoscope (a thin, lighted tube used to look at tissues inside the body). The endoscope is fitted with optical fibers (thin fibers that transmit light). It is inserted through an opening in the body, such as the mouth, nose, anus, or vagina. Laser light is then precisely aimed to cut or destroy a tumor.

Laser-induced interstitial thermotherapy (LITT), or interstitial laser photocoagulation, also uses lasers to treat some cancers. LITT is similar to a cancer treatment called hyperthermia, which uses heat to shrink tumors by damaging or killing cancer cells. During LITT, an optical fiber is inserted into a tumor. Laser light at the tip of the fiber raises the temperature of the tumor cells and damages or destroys them. LITT is sometimes used to shrink tumors in the liver.

Laser therapy can be used alone, but most often it is combined with other treatments, such as surgery, chemotherapy, or radiation therapy. In addition, lasers can seal nerve endings to reduce pain after surgery and seal lymph vessels to reduce swelling and limit the spread of tumor cells.

Lasers used to treat cancer may include carbon dioxide ($CO_2$) lasers, argon lasers, and neodymium:yttrium-aluminum-garnet (Nd:YAG) lasers. Each of these can shrink or destroy tumors and can be used with endoscopes. $CO_2$ and argon lasers can cut the skin's surface without going into deeper layers. Thus, they can be used to remove superficial cancers, such as skin cancer. In contrast, the Nd:YAG laser is more commonly applied through an endoscope to treat internal organs, such as the uterus, esophagus, and colon. Nd:YAG laser light can also travel through optical fibers into specific areas of the body during LITT. Argon lasers are often used to activate the drugs used in PDT.

For patients with high test scores consistent with systemic disease outcome after prostatectomy, additional treatment modalities such as adjuvant chemotherapy (e.g., docetaxel, mitoxantrone and prednisone), systemic radiation therapy (e.g., samarium or strontium) and/or anti-androgen therapy (e.g., surgical castration, finasteride, dutasteride) can be designated. Such patients would likely be treated immediately with anti-androgen therapy alone or in combination with radiation therapy in order to eliminate presumed micro-metastatic disease, which cannot be detected clinically but can be revealed by the target sequence expression signature.

Such patients can also be more closely monitored for signs of disease progression. For patients with intermediate test scores consistent with biochemical recurrence only (BCR-only or elevated PSA that does not rapidly become manifested as systemic disease only localized adjuvant therapy (e.g., radiation therapy of the prostate bed) or short course of anti-androgen therapy would likely be administered. For patients with low scores or scores consistent with no evidence of disease (NED) adjuvant therapy would not likely be recommended by their physicians in order to avoid treatment-related side effects such as metabolic syndrome (e.g., hypertension, diabetes and/or weight gain), osteoporosis, proctitis, incontinence or impotence. Patients with samples consistent with NED could be designated for watchful waiting, or for no treatment. Patients with test scores that do not correlate with systemic disease but who have successive PSA increases could be designated for watchful waiting, increased monitoring, or lower dose or shorter duration anti-androgen therapy.

Target sequences can be grouped so that information obtained about the set of target sequences in the group can be used to make or assist in making a clinically relevant judgment such as a diagnosis, prognosis, or treatment choice.

A patient report is also provided comprising a representation of measured expression levels of a plurality of target sequences in a biological sample from the patient, wherein the representation comprises expression levels of target sequences corresponding to any one, two, three, four, five, six, eight, ten, twenty, thirty, fifty or more of the target sequences corresponding to a target selected from any of Tables 2, 4, 11 and 55, or of the subsets described herein, or of a combination thereof. In some instances, the target is selected from Table 2. In other instances, the target is selected from Table 4. In some embodiments, the target is selected from Table 11. In some embodiments, the representation of the measured expression level(s) may take the form of a linear or nonlinear combination of expression levels of the target sequences of interest. The patient report may be provided in a machine (e.g., a computer) readable format and/or in a hard (paper) copy. The report can also include standard measurements of expression levels of said plurality of target sequences from one or more sets of patients with known disease status and/or outcome. The report can be used to inform the patient and/or treating physician of the expression levels of the expressed target sequences, the likely medical diagnosis and/or implications, and optionally may recommend a treatment modality for the patient.

Also provided are representations of the gene expression profiles useful for treating, diagnosing, prognosticating, and otherwise assessing disease. In some embodiments, these profile representations are reduced to a medium that can be automatically read by a machine such as computer readable media (magnetic, optical, and the like). The articles can also include instructions for assessing the gene expression profiles in such media. For example, the articles may comprise a readable storage form having computer instructions for comparing gene expression profiles of the portfolios of genes described above. The articles may also have gene expression profiles digitally recorded therein so that they may be compared with gene expression data from patient samples. Alternatively, the profiles can be recorded in different representational format. A graphical recordation is one such format. Clustering algorithms can assist in the visualization of such data.

EXEMPLARY EMBODIMENTS

Disclosed herein, in some embodiments, is a method for diagnosing, predicting, and/or monitoring a status or outcome of a cancer a subject, comprising: (a) assaying an expression level of a plurality of targets in a sample from the subject, wherein at least one target of the plurality of targets is selected from the group consisting of targets identified in Tables 2, 4, 11 and 55; and (b) for diagnosing, predicting, and/or monitoring a status or outcome of a cancer based on the expression levels of the plurality of targets. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a thyroid cancer. In some embodiments, the cancer is a bladder cancer. In some embodiments, the cancer is a lung cancer. In some embodiments, the method further comprises assaying an expression level of a coding target. In some instances, the coding target is selected from the group consisting of targets identified in Tables 2, 4, 11 and 55. In some embodiments, the coding target is an exon-coding transcript. In some embodiments, the exon-coding transcript is an exonic sequence. In some embodiments, the method further comprises assaying an expression level of a non-coding target. In some instances, the non-coding target is selected from the group consisting of targets identified in Tables 2, 4, 11 and 55. In some instances, the non-coding target is a non-coding transcript. In other instances, the non-coding target is an intronic sequence. In other instances, the non-coding target is an intergenic sequence. In some instances, the non-coding target is a UTR sequence. In other instances, the non-coding target is a non-coding RNA transcript. In some embodiments, the target comprises a nucleic acid sequence. In some embodiments, the nucleic acid sequence is a DNA sequence. In some embodiments, the nucleic acid sequence is an RNA sequence. In other instances, the target comprises a polypeptide sequence. In some instances, the plurality of targets comprises 2 or more targets selected from the group of targets identified in Tables 2, 4, 11 and 55. In some instances, the plurality of targets comprises 5 or more targets selected from the group of targets identified in Tables 2, 4, 11 and 55. In some instances, the plurality of targets comprises 10 or more targets selected from the group of targets identified in Tables 2, 4, 11 and 55. In some instances, the plurality of targets comprises 15 or more targets selected from the group of targets identified in Tables 2, 4, 11 and 55. In some instances, the plurality of targets comprises 20 or more targets selected from the group of targets identified in Tables 2, 4, 11 and 55. In some instances, the plurality of targets comprises 25 or more targets selected from the group of targets identified in Tables 2, 4, 11 and 55. In some instances, the plurality of targets comprises 30 or more targets selected from the group of targets identified in Tables 2, 4, 11 and 55. In some instances, the plurality of targets comprises 35 or more targets selected from the group of targets identified in Tables 2, 4, 11 and 55. In some instances, the plurality of targets comprises 40 or more targets selected from the group of targets identified in Tables 2, 4, 11 and 55. In some instances, the target is selected from Table 2. In other instances, the target is selected from Table 4. In some embodiments, the target is selected from Table 11. In some embodiments, assaying the expression level comprises detecting and/or quantifying a nucleotide sequence of the plurality of targets. Alternatively, assaying the expression level comprises detecting and/or quantifying a polypeptide sequence of the plurality of targets. In some embodiments, assaying the expression level comprises detecting and/or quantifying the DNA levels of the plurality of targets. In some embodiments, assaying the expression level comprises detecting and/or quantifying the RNA or mRNA levels of the plurality of targets. In some embodiments, assaying the expression level comprises detecting and/or quantifying the protein level of the plurality of targets. In some embodiments, the diagnosing, predicting, and/or monitoring the status or outcome of a cancer comprises determining the malignancy of the cancer. In some embodiments, the diagnosing, predicting, and/or monitoring the status or outcome of a cancer includes determining the stage of the cancer. In some embodiments, the diagnosing, predicting, and/or monitoring the status or outcome of a cancer includes assessing the risk of cancer recurrence. In some embodiments, diagnosing, predicting, and/or monitoring the status or outcome of a cancer may comprise determining the efficacy of treatment. In some embodiments, diagnosing, predicting, and/or monitoring the status or outcome of a cancer may comprise determining a therapeutic regimen. Determining a therapeutic regimen may comprise administering an anti-cancer therapeutic. Alternatively, determining the treatment for the cancer may comprise modifying a therapeutic regimen. Modifying a therapeutic regimen may comprise increasing, decreasing, or terminating a therapeutic regimen.

Further disclosed, in some embodiments, is method for determining a treatment for a cancer in a subject, comprising: a) assaying an expression level of a plurality of targets in a sample from the subject, wherein at least one target of the plurality of targets is selected from the group consisting of targets identified in Tables 2, 4, 11 and 55; and b) determining the treatment for a cancer based on the expression levels of the plurality of targets. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a bladder cancer. In some embodiments, the cancer is a thyroid cancer. In some embodiments, the cancer is a lung cancer. In some embodiments, the coding target is selected from a sequence listed in Tables 2, 4, 11 and 55. In some embodiments, the method further comprises assaying an expression level of a coding target. In some instances, the coding target is selected from the group consisting of targets identified in Tables 2, 4, 11 and 55. In some embodiments, the coding target is an exon-coding transcript. In some embodiments, the exon-coding transcript is an exonic sequence. In some embodiments, the method further comprises assaying an expression level of a non-coding target. In some instances, the non-coding target is selected from the group consisting of targets identified in Tables 2, 4, 11 and 55. In some instances, the non-coding target is a non-coding transcript. In other instances, the non-coding target is an intronic sequence. In other instances, the non-coding target is an intergenic sequence. In some instances, the non-coding target is a UTR sequence. In other instances, the non-coding target is a non-coding RNA transcript. In some embodiments, the target comprises a nucleic acid sequence. In some embodiments, the nucleic acid sequence is a DNA sequence. In some embodiments, the nucleic acid sequence is an RNA sequence. In other instances, the target comprises a polypeptide sequence. In some instances, the plurality of targets comprises 2 or more targets selected from the group of targets identified in Tables 2, 4, 11 and 55. In some instances, the plurality of targets comprises 5 or more targets selected from the group of targets identified in Tables 2, 4, 11 and 55. In some instances, the plurality of targets comprises 10 or more targets selected from the group of targets identified in Tables 2, 4, 11 and 55. In some instances, the plurality of targets comprises 15 or more targets selected from the group of targets identified in Tables 2, 4, 11 and 55. In some instances, the plurality of targets comprises 20 or more targets selected from the group of targets identified in Tables 2, 4, 11 and 55. In some instances, the plurality of targets comprises 25 or more targets selected from the group of targets identified in Tables 2, 4, 11 and 55. In some instances, the plurality of targets comprises 30 or more targets selected from the group of targets identified in Tables 2, 4, 11 and 55.

In some instances, the plurality of targets comprises 35 or more targets selected from the group of targets identified in Tables 2, 4, 11 and 55. In some instances, the plurality of targets comprises 40 or more targets selected from the group of targets identified in Tables 2, 4, 11 and 55. In some instances, the target is selected from Table 2. In other instances, the target is selected from Table 4. In some embodiments, the target is selected from Table 11. In some embodiments, assaying the expression level comprises detecting and/or quantifying a nucleotide sequence of the plurality of targets. In some embodiments, determining the treatment for the cancer includes determining the efficacy of treatment. Determining the treatment for the cancer may comprise administering an anti-cancer therapeutic. Alternatively, determining the treatment for the cancer may comprise modifying a therapeutic regimen. Modifying a therapeutic regimen may comprise increasing, decreasing, or terminating a therapeutic regimen.

The methods use the probe sets, probes and primers described herein to provide expression signatures or profiles from a test sample derived from a subject having or suspected of having cancer. In some embodiments, such methods involve contacting a test sample with a probe set comprising a plurality of probes under conditions that permit hybridization of the probe(s) to any target nucleic acid(s) present in the test sample and then detecting any probe:target duplexes formed as an indication of the presence of the target nucleic acid in the sample. Expression patterns thus determined are then compared to one or more reference profiles or signatures. Optionally, the expression pattern can be normalized. The methods use the probe sets, probes and primers described herein to provide expression signatures or profiles from a test sample derived from a subject to classify the cancer as recurrent or non-recurrent.

In some embodiments, such methods involve the specific amplification of target sequences nucleic acid(s) present in the test sample using methods known in the art to generate an expression profile or signature which is then compared to a reference profile or signature.

In some embodiments, the invention further provides for prognosing patient outcome, predicting likelihood of recurrence after prostatectomy and/or for designating treatment modalities.

In one embodiment, the methods generate expression profiles or signatures detailing the expression of the target sequences having altered relative expression with different cancer outcomes.

In some embodiments, the methods detect combinations of expression levels of sequences exhibiting positive and negative correlation with a disease status. In one embodiment, the methods detect a minimal expression signature.

The gene expression profiles of each of the target sequences comprising the portfolio can fixed in a medium such as a computer readable medium. This can take a number of forms. For example, a table can be established into which the range of signals (e.g., intensity measurements) indicative of disease or outcome is input. Actual patient data can then be compared to the values in the table to determine the patient samples diagnosis or prognosis. In a more sophisticated embodiment, patterns of the expression signals (e.g., fluorescent intensity) are recorded digitally or graphically.

The expression profiles of the samples can be compared to a control portfolio. The expression profiles can be used to diagnose, predict, or monitor a status or outcome of a cancer. For example, diagnosing, predicting, or monitoring a status or outcome of a cancer may comprise diagnosing or detecting a cancer, cancer metastasis, or stage of a cancer. In other instances, diagnosing, predicting, or monitoring a status or outcome of a cancer may comprise predicting the risk of cancer recurrence. Alternatively, diagnosing, predicting, or monitoring a status or outcome of a cancer may comprise predicting mortality or morbidity.

Further disclosed herein are methods for characterizing a patient population. Generally, the method comprises: (a) providing a sample from a subject; (b) assaying the expression level for a plurality of targets in the sample; and (c) characterizing the subject based on the expression level of the plurality of targets. In some embodiments, the method further comprises assaying an expression level of a coding target. In some instances, the coding target is selected from the group consisting of targets identified in Tables 2, 4, 11 and 55. In some embodiments, the coding target is an exon-coding transcript. In some embodiments, the exon-coding transcript is an exonic sequence. In some embodiments, the method further comprises assaying an expression level of a non-coding target. In some instances, the non-coding target is selected from the group consisting of targets identified in Tables 2, 4, 11 and 55. In some instances, the non-coding target is a non-coding transcript. In other instances, the non-coding target is an intronic sequence. In other instances, the non-coding target is an intergenic sequence. In some instances, the non-coding target is a UTR sequence. In other instances, the non-coding target is a non-coding RNA transcript. In some embodiments, the target comprises a nucleic acid sequence. In some embodiments, the nucleic acid sequence is a DNA sequence. In some embodiments, the nucleic acid sequence is an RNA sequence. In other instances, the target comprises a polypeptide sequence. In some instances, the plurality of targets comprises 2 or more targets selected from the group of targets identified in Tables 2, 4, 11 and 55. In some instances, the plurality of targets comprises 5 or more targets selected from the group of targets identified in Tables 2, 4, 11 and 55. In some instances, the plurality of targets comprises 10 or more targets selected from the group of targets identified in Tables 2, 4, 11 and 55. In some instances, the plurality of targets comprises 15 or more targets selected from the group of targets identified in Tables 2, 4, 11 and 55. In some instances, the plurality of targets comprises 20 or more targets selected from the group of targets identified in Tables 2, 4, 11 and 55. In some instances, the plurality of targets comprises 25 or more targets selected from the group of targets identified in Tables 2, 4, 11 and 55. In some instances, the plurality of targets comprises 30 or more targets selected from the group of targets identified in Tables 2, 4, 11 and 55. In some instances, the plurality of targets comprises 35 or more targets selected from the group of targets identified in Tables 2, 4, 11 and 55. In some instances, the plurality of targets comprises 40 or more targets selected from the group of targets identified in Tables 2, 4, 11 and 55. In some instances, the target is selected from Table 2. In other instances, the target is selected from Table 4. In some embodiments, the target is selected from Table 11. In some embodiments, assaying the expression level comprises detecting and/or quantifying a nucleotide sequence of the plurality of targets. In some instances, the method may further comprise diagnosing a cancer in the subject. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a bladder cancer. In some embodiments, the cancer is a thyroid cancer. In some embodiments, the cancer is a lung cancer. In some instances, characterizing the subject comprises determining whether the subject would respond to an anti-cancer therapy. Alternatively, characterizing the subject comprises identifying the subject as a non-responder to an anti-cancer therapy. Optionally, characterizing the subject comprises identifying the subject as a responder to an anti-cancer therapy.

Further disclosed herein are methods for selecting a subject suffering from a cancer for enrollment into a clinical trial. Generally, the method comprises: (a) providing a sample from a subject; (b) assaying the expression level for a plurality of targets in the sample; and (c) characterizing the subject based on the expression level of the plurality of targets. In some embodiments, the method further comprises assaying an expression level of a coding target. In some instances, the coding target is selected from the group consisting of targets identified in Tables 2, 4, 11 and 55. In some embodiments, the coding target is an exon-coding transcript. In some embodiments, the exon-coding transcript is an exonic sequence. In some embodiments, the method further comprises assaying an expression level of a non-coding target. In some instances, the non-coding target is selected from the group consisting of targets identified in Tables 2, 4, 11 and 55. In some instances, the non-coding target is a non-coding transcript. In other instances, the non-coding target is an intronic sequence. In other instances, the non-coding target is an intergenic sequence. In some instances, the non-coding target is a UTR sequence. In other instances, the non-coding target is a non-coding RNA transcript. In some embodiments, the target comprises a nucleic acid sequence. In some embodiments, the nucleic acid sequence is a DNA sequence. In some embodiments, the nucleic acid sequence is an RNA sequence. In other instances, the target comprises a polypeptide sequence. In some instances, the plurality of targets comprises 2 or more targets selected from the group of targets identified in Tables 2, 4, 11 and 55. In some instances, the plurality of targets comprises 5 or more targets selected from the group of targets identified in Tables 2, 4, 11 and 55. In some instances, the plurality of targets comprises 10 or more targets selected from the group of targets identified in Tables 2, 4, 11 and 55. In some instances, the plurality of targets comprises 15 or more targets selected from the group of targets identified in Tables 2, 4, 11 and 55. In some instances, the plurality of targets comprises 20 or more targets selected from the group of targets identified in Tables 2, 4, 11 and 55. In some instances, the plurality of targets comprises 25 or more targets selected from the group of targets identified in Tables 2, 4, 11 and 55. In some instances, the plurality of targets comprises 30 or more targets selected from the group of targets identified in Tables 2, 4, 11 and 55. In some instances, the plurality of targets comprises 35 or more targets selected from the group of targets identified in Tables 2, 4, 11 and 55. In some instances, the plurality of targets comprises 40 or more targets selected from the group of targets identified in Tables 2, 4, 11 and 55. In some instances, the target is selected from Table 2. In other instances, the target is selected from Table 4. In some embodiments, the target is selected from Table 11. In some embodiments, assaying the expression level comprises detecting and/or quantifying a nucleotide sequence of the plurality of targets. In some instances, the method may further comprise diagnosing a cancer in the subject. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the cancer is a prostate cancer. In some embodiments, the cancer is a pancreatic cancer. In some embodiments, the cancer is a bladder cancer. In some embodiments, the cancer is a thyroid cancer. In some embodiments, the cancer is a lung cancer. In some instances, characterizing the subject comprises determining whether the subject would respond to an anti-cancer therapy. Alternatively, characterizing the subject comprises identifying the subject as a non-responder to an anti-cancer therapy. Optionally, characterizing the subject comprises identifying the subject as a responder to an anti-cancer therapy.

Further disclosed herein is a method of analyzing a cancer in an individual in need thereof, comprising (a) obtaining an expression profile from a sample obtained from the individual, wherein the expression profile comprises one or more targets selected from Tables 2, 4, 11 or 55; and (b) comparing the expression profile from the sample to an expression profile of a control or standard. In some embodiments, the plurality of targets comprises at least 5 targets selected from Tables 2, 4, 11 or 55. In some embodiments, wherein the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the method further comprises a software module executed by a computer-processing device to compare the expression profiles. In some embodiments, the method further comprises providing diagnostic or prognostic information to the individual about the cardiovascular disorder based on the comparison. In some embodiments, the method further comprises diagnosing the individual with a cancer if the expression profile of the sample (a) deviates from the control or standard from a healthy individual or population of healthy individuals, or (b) matches the control or standard from an individual or population of individuals who have or have had the cancer. In some embodiments, the method further comprises predicting the susceptibility of the individual for developing a cancer based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the method further comprises prescribing a treatment regimen based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the method further comprises altering a treatment regimen prescribed or administered to the individual based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the method further comprises predicting the individual's response to a treatment regimen based on (a) the deviation of the expression profile of the sample from a control or standard derived from a healthy individual or population of healthy individuals, or (b) the similarity of the expression profiles of the sample and a control or standard derived from an individual or population of individuals who have or have had the cancer. In some embodiments, the deviation is the expression level of one or more targets from the sample is greater than the expression level of one or more targets from a control or standard derived from a healthy individual or population of healthy individuals. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55 or a combination thereof. In some instances, the target is selected from Table 2. In other instances, the target is selected from Table 4. In some embodiments, the target is selected from Table 11. In some embodiments, the method further comprises amplifying the target, the probe, or any combination thereof. In some embodiments, the method further comprises sequencing the target, the probe, or any combination thereof. In some embodiments, the method further comprises converting the expression levels of the target sequences into a likelihood score that indicates the probability that a biological sample is from a patient who will exhibit no evidence of disease, who will exhibit systemic cancer, or who will exhibit biochemical recurrence. In some embodiments, the target sequences are differentially expressed the cancer. In some embodiments, the differential expression is dependent on aggressiveness. In some embodiments, the expression profile is determined by a method selected from the group consisting of RT-PCR, Northern blotting, ligase chain reaction, array hybridization, and a combination thereof.

Also disclosed herein is a method of diagnosing cancer in an individual in need thereof, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) diagnosing a cancer in the individual if the expression profile of the sample (i) deviates from the control or standard from a healthy individual or population of healthy individuals, or (ii) matches the control or standard from an individual or population of individuals who have or have had the cancer. In some embodiments, the plurality of targets comprises at least 5 targets selected from Tables 2, 4, 11 or 55. In some embodiments, wherein the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the method further comprises a software module executed by a computer-processing device to compare the expression profiles. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises converting the expression levels of the target sequences into a likelihood score that indicates the probability that a biological sample is from a patient who will exhibit no evidence of disease, who will exhibit systemic cancer, or who will exhibit biochemical recurrence. In some embodiments, the target sequences are differentially expressed the cancer. In some embodiments, the differential expression is dependent on aggressiveness. In some embodiments, the expression profile is determined by a method selected from the group consisting of RT-PCR, Northern blotting, ligase chain reaction, array hybridization, and a combination thereof.

In some embodiments is a method of predicting whether an individual is susceptible to developing a cancer, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) predicting the susceptibility of the individual for developing a cancer based on (i) the deviation of the expression profile of the sample from a control or standard derived from a healthy individual or population of healthy individuals, or (ii) the similarity of the expression profiles of the sample and a control or standard derived from an individual or population of individuals who have or have had the cancer. In some embodiments, the plurality of targets comprises at least 5 targets selected from Tables 2, 4, 11 or 55. In some embodiments, wherein the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some instances, the target is selected from Table 2. In other instances, the target is selected from Table 4. In some embodiments, the target is selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the method further comprises a software module executed by a computer-processing device to compare the expression profiles. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises converting the expression levels of the target sequences into a likelihood score that indicates the probability that a biological sample is from a patient who will exhibit no evidence of disease, who will exhibit systemic cancer, or who will exhibit biochemical recurrence. In some embodiments, the target sequences are differentially expressed the cancer. In some embodiments, the differential expression is dependent on aggressiveness. In some embodiments, the expression profile is determined by a method selected from the group consisting of RT-PCR, Northern blotting, ligase chain reaction, array hybridization, and a combination thereof.

In some embodiments is a method of predicting an individual's response to a treatment regimen for a cancer, comprising: (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) predicting the individual's response to a treatment regimen based on (i) the deviation of the expression profile of the sample from a control or standard derived from a healthy individual or population of healthy individuals, or (ii) the similarity of the expression profiles of the sample and a control or standard derived from an individual or population of individuals who have or have had the cancer. In some embodiments, the plurality of targets comprises at least 5 targets selected from Tables 2, 4, 11 or 55. In some embodiments, wherein the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some instances, the target is selected from Table 2. In other instances, the target is selected from Table 4. In some embodiments, the target is selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the method further comprises a software module executed by a computer-processing device to compare the expression profiles. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof. In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises converting the expression levels of the target sequences into a likelihood score that indicates the probability that a biological sample is from a patient who will exhibit no evidence of disease, who will exhibit systemic cancer, or who will exhibit biochemical recurrence. In some embodiments, the target sequences are differentially expressed the cancer. In some embodiments, the differential expression is dependent on aggressiveness. In some embodiments, the expression profile is determined by a method selected from the group consisting of RT-PCR, Northern blotting, ligase chain reaction, array hybridization, and a combination thereof.

A method of prescribing a treatment regimen for a cancer to an individual in need thereof, comprising (a) obtaining an expression profile from a sample obtained from the individual, wherein the expression profile comprises one or more targets selected from Tables 2, 4, 11 or 55; (b) comparing the expression profile from the sample to an expression profile of a control or standard; and (c) prescribing a treatment regimen based on (i) the deviation of the expression profile of the sample from a control or standard derived from a healthy individual or population of healthy individuals, or (ii) the similarity of the expression profiles of the sample and a control or standard derived from an individual or population of individuals who have or have had the cancer. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some instances, the target is selected from Table 2. In other instances, the target is selected from Table 4. In some embodiments, the target is selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas. In some embodiments, the method further comprises a software module executed by a computer-processing device to compare the expression profiles. In some embodiments, the deviation is the expression level of one or more targets from the sample is at least about 30% greater than the expression level of one or more targets from a control or standard derived from a healthy individual or population of healthy individuals. In some embodiments, the deviation is the expression level of one or more targets from the sample is less than the expression level of one or more targets from a control or standard derived from a healthy individual or population of healthy individuals. In some embodiments, the deviation is the expression level of one or more targets from the sample is at least about 30% less than the expression level of one or more targets from a control or standard derived from a healthy individual or population of healthy individuals. In some embodiments, the method further comprises using a machine to isolate the target or the probe from the sample. In some embodiments, the method further comprises contacting the sample with a label that specifically binds to the target, the probe, or a combination thereof.

In some embodiments, the method further comprises contacting the sample with a label that specifically binds to a target selected from Tables 2, 4, 11 or 55, or a combination thereof. In some embodiments, the method further comprises amplifying the target, the probe, or any combination thereof. In some embodiments, the method further comprises sequencing the target, the probe, or any combination thereof. In some embodiments, the method further comprises converting the expression levels of the target sequences into a likelihood score that indicates the probability that a biological sample is from a patient who will exhibit no evidence of disease, who will exhibit systemic cancer, or who will exhibit biochemical recurrence. In some embodiments, the target sequences are differentially expressed the cancer. In some embodiments, the differential expression is dependent on aggressiveness. In some embodiments, the expression profile is determined by a method selected from the group consisting of RT-PCR, Northern blotting, ligase chain reaction, array hybridization, and a combination thereof.

Further disclosed herein is a kit for analyzing a cancer, comprising (a) a probe set comprising a plurality of target sequences, wherein the plurality of target sequences comprises at least one target sequence listed in Table 11; and (b) a computer model or algorithm for analyzing an expression level and/or expression profile of the target sequences in a sample. In some embodiments, the kit further comprises a computer model or algorithm for correlating the expression level or expression profile with disease state or outcome. In some embodiments, the kit further comprises a computer model or algorithm for designating a treatment modality for the individual. In some embodiments, the kit further comprises a computer model or algorithm for normalizing expression level or expression profile of the target sequences. In some embodiments, the kit further comprises a computer model or algorithm comprising a robust multichip average (RMA), probe logarithmic intensity error estimation (PLIER), non-linear fit (NLFIT) quantile-based, nonlinear normalization, or a combination thereof. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some instances, the target is selected from Table 2. In other instances, the target is selected from Table 4. In some embodiments, the target is selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas.

Further disclosed herein is a system for analyzing a cancer, comprising (a) a probe set comprising a plurality of target sequences, wherein (i) the plurality of target sequences hybridizes to one or more targets selected from Tables 2 or 4; or (ii) the plurality of target sequences comprises one or more target sequences selected from Table 11; and (b) a computer model or algorithm for analyzing an expression level and/or expression profile of the target hybridized to the probe in a sample from a subject suffering from a cancer. In some embodiments, the system further comprises electronic memory for capturing and storing an expression profile. In some embodiments, the system further comprises a computer-processing device, optionally connected to a computer network. In some embodiments, the system further comprises a software module executed by the computer-processing device to analyze an expression profile. In some embodiments, the system further comprises a software module executed by the computer-processing device to compare the expression profile to a standard or control. In some embodiments, the system further comprises a software module executed by the computer-processing device to determine the expression level of the target. In some embodiments, the system further comprises a machine to isolate the target or the probe from the sample. In some embodiments, the system further comprises a machine to sequence the target or the probe. In some embodiments, the system further comprises a machine to amplify the target or the probe. In some embodiments, the system further comprises a label that specifically binds to the target, the probe, or a combination thereof. In some embodiments, the system further comprises a software module executed by the computer-processing device to transmit an analysis of the expression profile to the individual or a medical professional treating the individual. In some embodiments, the system further comprises a software module executed by the computer-processing device to transmit a diagnosis or prognosis to the individual or a medical professional treating the individual. In some embodiments, the plurality of targets comprises at least 5 targets selected from Tables 2, 4, 11 or 55. In some embodiments, the plurality of targets comprises at least 10 targets selected from Tables 2, 4, 11 or 55. In some embodiments, the plurality of targets comprises at least 15 targets selected from Tables 2, 4, 11 or 55. In some embodiments, the plurality of targets comprises at least 20 targets selected from Tables 2, 4, 11 or 55. In some instances, the target is selected from Table 2. In other instances, the target is selected from Table 4. In some embodiments, the target is selected from Table 11. In some embodiments, the cancer is selected from the group consisting of a carcinoma, sarcoma, leukemia, lymphoma, myeloma, and a CNS tumor. In some embodiments, the cancer is selected from the group consisting of skin cancer, lung cancer, colon cancer, pancreatic cancer, prostate cancer, liver cancer, thyroid cancer, ovarian cancer, uterine cancer, breast cancer, cervical cancer, kidney cancer, epithelial carcinoma, squamous carcinoma, basal cell carcinoma, melanoma, papilloma, and adenomas.

Examples

Example 1. Validation Studies in Subjects with Prostate Cancer

Study Design

This study used a previously described case-control study for biomarker discovery and a case-cohort for independent validation. A STROBE flow diagram providing an overview of the case-control study is available in (FIG. 1).

The discovery study was a nested case-control described in detail in Nakagawa et al 2008. Archived formalin-fixed paraffin embedded (FFPE) blocks of tumors were selected from 621 patients that had undergone a radical prostatectomy (RP) at the Mayo Clinic Comprehensive Cancer Centre between the years 1987-2001 providing a median of 18.16 years of follow-up. The patients were randomly split into a training and test sets; the training set was used for biomarker discovery and classifier development and the testing set was used to measure performance and with model selection.

Patients were retrospectively classified into one of three outcomes: NED: No evidence of disease for those patients with no biochemical or other clinical signs of disease progression (at least 10 years follow-up); PSA: prostate-specific antigen biochemical recurrence for those patients with two successive increases in PSA measurements above an established cut-point of >0.2 ng/(with the subsequent measure 0.05 ng/mL above the first measurement) within 5 years of RP and no detectable metases up to 10 years after RP; METS: for those patients experience BCR within 5 years of RP and that developed metastases (confirmed by bone or CT scan) within 5 years of BCR. Patient selection for nested case-control design is outlined in Nakagawa.

On average, METS patients were diagnosed within 3.22 years following BCR and 5.79 years following RP, implying that this METS group experienced rapid onset of metastatic disease. Some PSA patients do experience metastatic disease (n=18, or 9.9% of all PSA patients in the discovery study), however, these patients have the event 10 years beyond RP and thus are outside the MET definition. Due to the condition that both PSA and MET groups had to experience BCR event within 5 years of RP, there is no statistically significant difference for the time to BCR between PSA (median: 1.70 years [IQR:0.65-3.44]) and MET (median: 2.26 years [IQR: 0.78-3.94]) groups. Patients in this study did not receive a consistent treatment regimen, and may be highly treated with adjuvant interventions compared to other cohorts. Where possible we account for adjuvant interventions in analysis to mitigate its impact as a confounding factor (See Statistical Analysis).

We conducted a study that investigated the differences between NED, PSA and METS outcome groups and found there to be no statistically significant differences between the NED and PSA groups, with the largest difference in genomic and clinicopathologic variables to be found when comparing METS against NED or PSA groups. We have evidence to believe that NED and PSA groups may represent a less aggressive type of prostate cancer, and that these patients will likely not experience metastatic progression in their life-time, conversely METS patients represent rapid disease onset and more aggressive prostate cancer. To maximize discovery of biomarkers that identified oncogenic drivers of aggressive disease, we combined the NED and PSA groups into a unified Non-METS group to compare against the METS.

The discovery study included 621 patients who underwent RP at the Mayo Clinic between 1987-2001. Patients who received neo-adjuvant interventions were excluded. After chip quality control (www.affymetrix.com), 545 unique patients (209 with mets after RP and 336 with BCR only or NED) were available for the biomarker discovery study (median follow-up, 18.2 years). The study patients were further subdivided by random draw into training (n=359) and testing (n=186) subsets, balancing for the distribution of clinicopathologic variables (Table 1) as previously described.

TABLE 1

Clinical characteristics of Discovery and Validation data set

| Clinical variable | Values | Discovery | | | | Independent Validation | |
|---|---|---|---|---|---|---|---|
| | | Training | | Testing | | | |
| | | No mets | mets | No mets | mets | No mets | mets |
| # patients | — | 218 | 141 | 118 | 68 | 150 | 69 |
| Pathological Tumour Stage | T2 | 105 | 40 | 56 | 18 | 71 | 14 |
| | T3/4 | 101 | 67 | 18 | 37 | 62 | 40 |
| | TxN+ | 12 | 34 | 14 | 13 | 17 | 15 |
| Pre-Op PSA | <10 ng/ml | 124 | 66 | 58 | 34 | 86 | 33 |
| | ≥10≤20 | 53 | 31 | 22 | 11 | 39 | 20 |
| | >20 ng/ml | 38 | 43 | 33 | 17 | 25 | 16 |
| | NA | 3 | 1 | 5 | 6 | 0 | 0 |
| Pathological Gleason score | ≤6 | 41 | 4 | 16 | 2 | 15 | 0 |
| | 7 | 125 | 49 | 70 | 27 | 82 | 29 |
| | ≥8 | 52 | 88 | 32 | 39 | 53 | 40 |
| Path features | SM+ | 98 | 81 | 54 | 33 | 84 | 39 |
| | ECE+ | 96 | 86 | 50 | 41 | 54 | 44 |
| | SVI+ | 47 | 63 | 34 | 32 | 45 | 36 |
| Biochemical recurrence (BCR) | Censored | 99 | 0 | 58 | 0 | 109 | 0 |
| | Event | 119 | 141 | 60 | 68 | 41 | 69 |
| Prostate-specific mortality (PCSM) | Censored | 216 | 47 | 117 | 33 | 150 | 41 |
| | Event | 2 | 94 | 1 | 35 | 0 | 28 |
| Adjuvant Radiation | No | 203 | 120 | 112 | 56 | 135 | 60 |
| | Yes | 15 | 21 | 6 | 12 | 15 | 9 |
| Adjuvant ADT | No | 187 | 95 | 89 | 50 | 108 | 37 |
| | Yes | 31 | 46 | 29 | 18 | 42 | 32 |

Figure 2:
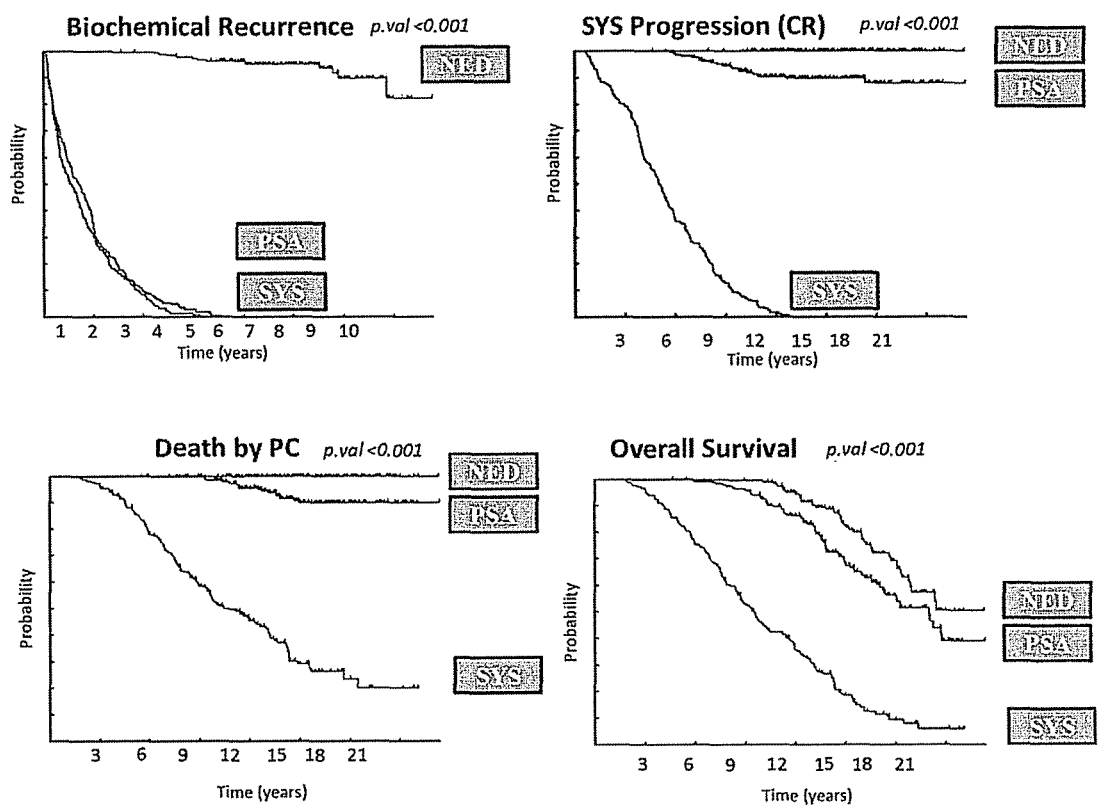
FIG. 2. KM curves for BCR, METS, PCSM and Overall Survival events for NED, PSA and METs patients in the Discovery cohort. For each plot, probability of the event (BCR, METS, PCSM or OS) is shown in the Y-Axis. METS are also named SYS (for systemic event) or CR (for Clinical Recurrence).

The initial Clinical characteristics of these samples related to biochemical recurrence (BCR), METS (or clinical recurrence (CR)), prostate cancer specific mortality (PCSM) and overall survival are shown in FIG. 2.

Subjects for independent validation were identified from a population of 1,010 men prospectively enrolled in the Mayo Clinic tumor registry who underwent RP for prostatic adenocarcinoma from 2000-2006 and were at high risk for disease recurrence. High-risk for recurrence was defined by pre-operative PSA >20 ng/mL, or pathological Gleason score≥8, or seminal vesicle invasion (SVI) or GPSM (Gleason, PSA, seminal vesicle and margin status) score≥10. Data was collected using a case-cohort design over the follow-up period (median, 8.06 years), 71 patients developed metastatic disease (mets) as evidenced by positive bone and/or CT scans. Data was collected using a case-cohort design, which involved selection of all 73 cases combined with a random sample of 202 patients (~20%) from the entire cohort. After exclusion for tissue unavailability and samples that failed microarray quality control, the independent validation cohort consisted of 219 (69 cases) unique patients.

RNA Extraction and Microarray Hybridization

Following pathological review of FFPE primary prostatic adenocarcinoma specimens from patients in the discovery and validation cohorts, tumor was macrodissected from surrounding stroma from 3-4 10 μm tissue sections. Total RNA was extracted, amplified using the Ovation FFPE kit (NuGEN, San Carlos, Calif.), and hybridized to Human Exon 1.0 ST GeneChips (Affymetrix, Santa Clara, Calif.) that profiles coding and non-coding regions of the transcriptome using approximately 1.4 million probe selection regions, hereinafter referred to as features.

For the discovery study, total RNA was prepared as described herein. For the independent validation study, total RNA was extracted and purified using a modified protocol for the commercially available RNeasy FFPE nucleic acid extraction kit (Qiagen Inc., Valencia, Calif.). RNA concentrations were determined using a Nanodrop ND-1000 spectrophotometer (Nanodrop Technologies, Rockland, Del.). Purified total RNA was subjected to whole-transcriptome amplification using the WT-Ovation FFPE system according to the manufacturer's recommendation with minor modifications (NuGen, San Carlos, Calif.). For the discovery study the WT-Ovation FFPE V2 kit was used together with the Exon Module while for the validation only the Ovation® FFPE WTA System was used. Amplified products were fragmented and labeled using the Encore™ Biotin Module (NuGen, San Carlos, Calif.) and hybridized to Affymetrix Human Exon (HuEx) 1.0 ST GeneChips following manufacturer's recommendations (Affymetrix, Santa Clara, Calif.). Only 604 out of a total 621 patients had specimens available for hybridization.

Microarray Processing

Microarray Quality Control

The Affymetrix Power Tools packages provide an index characterizing the quality of each chip, independently, named "pos_vs_neg_AUC". This index compares signal values for positive and negative control probesets defined by the manufacturer. Values for the AUC are in [0, 1], arrays that fall under 0.6 were removed from analysis.

Only 545 unique samples, out of the total 604 with available specimens (inter- and intra-batch duplicates were run), were of sufficient quality for further analysis; 359 and 187 samples were available from the training and testing sets respectively. We re-evaluated the variable balance between the training and testing sets and found there to be no statistically significant difference for any of the variables.

Microarray Normalization, Probeset Filtering, and Batch Effect Correction

Probeset summarization and normalization was performed by fRMA, which is available through Bioconductor. The fRMA algorithm relates to RMA with the exception that it specifically attempts to consider batch effect during probeset summarization and is capable of storing the model parameters in so called 'frozen vectors'. We generated a custom set of frozen vectors by randomly selecting 15 arrays from each of the 19 batches in the discovery study. The frozen vectors can be applied to novel data without having to renormalize the entire dataset. We furthermore filtered out unreliable PSRs by removing cross-hybridizing probes as well as high PSRs variability of expression values in a prostate cancer cell line and those with fewer than 4 probes. Following fRMA and filtration the data was decomposed into its principal components and an analysis of variance model was used to determine the extent to which a batch effect remains present in the first 10 principal components. We chose to remove the first two principal components, as they were highly correlated with the batch processing date.

Non-Coding RNA Analysis

Sequence information from each probe in a PSR can be aligned and annotated against the human reference genome by xmapcore (Yates, et al., X:Map: Annotation and visualization of genome structure for Affymetrix exon array analysis, *Nucleic Acids Res*. (2008), Epub.) Using annotation data from the human genome version hg19/GRCh37 (Ensembl annotation release 62), we categorize the PSRs into coding, non-coding (UTR) and non-coding (intronic) as defined by xmapcore.

The PSRs that cannot be categorized in the groups above are further categorized as follows:

Non-coding (Non-unique): one or more probes don't align perfectly to the genome, or one or more probes align perfectly to multiple regions of the genome.

Non-coding (ncTranscript): PSR correspond to the exon of a non-coding transcript.

Non-coding (CDS_Antisense): PSR corresponds to a segment in the opposite strand of the coding sequence of a protein-coding transcript.

Non-coding (UTR_Antisense): PSR corresponds to a segment in the opposite strand of the UTR sequence (5' or 3') of a transcript.

Non-coding (Intronic_Antisense): PSR correspond to a segment in the opposite strand of the intronic sequence of a protein-coding transcript.

Non-coding (ncTranscript_Antisense): PSR correspond to the exon of a non-coding transcript in the opposite strand.

Non-coding (Intergenic): if the probes were not categorized under any of the groups above and it is annotated as 'intergenic' by xmapcore.

We additionally used xmapcore to annotate the gene symbol, gene synonym, Ensembl gene ID and biological description for any PSRs that overlapped with a transcript when necessary; this excludes alignments to non-coding (non-unique) and non-coding (intergenic) sequences.

Example 2: A 43-Biomarker Set for Prostate Cancer

Figure 3:
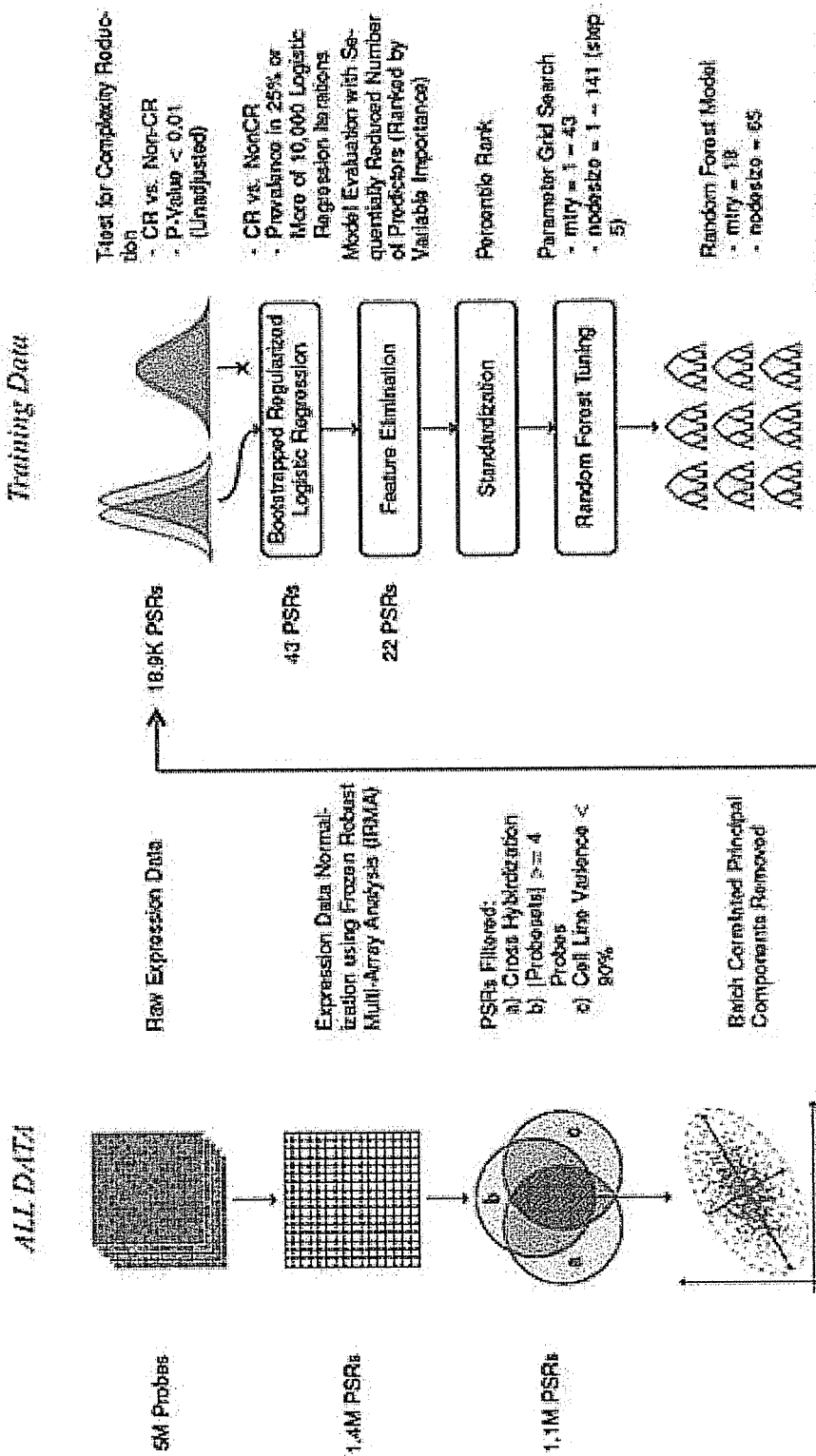
FIG. 3. 43-Biomarker Set Methods

Overview of the entire microarray analysis pipeline is provided in FIG. 3.

Feature Selection

The remaining features following the analysis in Example 1 were subjected to filtration by a t-test between the METS and non-METS samples in the training set (n=359). Using a p-value cut-off of 0.01, 18,902 features remain in analysis for further selection. Feature selection was performed by regularized logistic regression using the elastic-net penalty through the glmnet v1.7 package available in R with an alpha-value of 0.5 with three-fold cross validation. The regularized regression, with cross validation, was bootstrapped over 1000 times using all training data (n=359); with each iteration of bootstrapping we tabulated features that had a non-zero co-efficient. Features that were selected in at least 25% of the total runs were used for model building.

Non-Coding RNA Analysis

Figure 4:
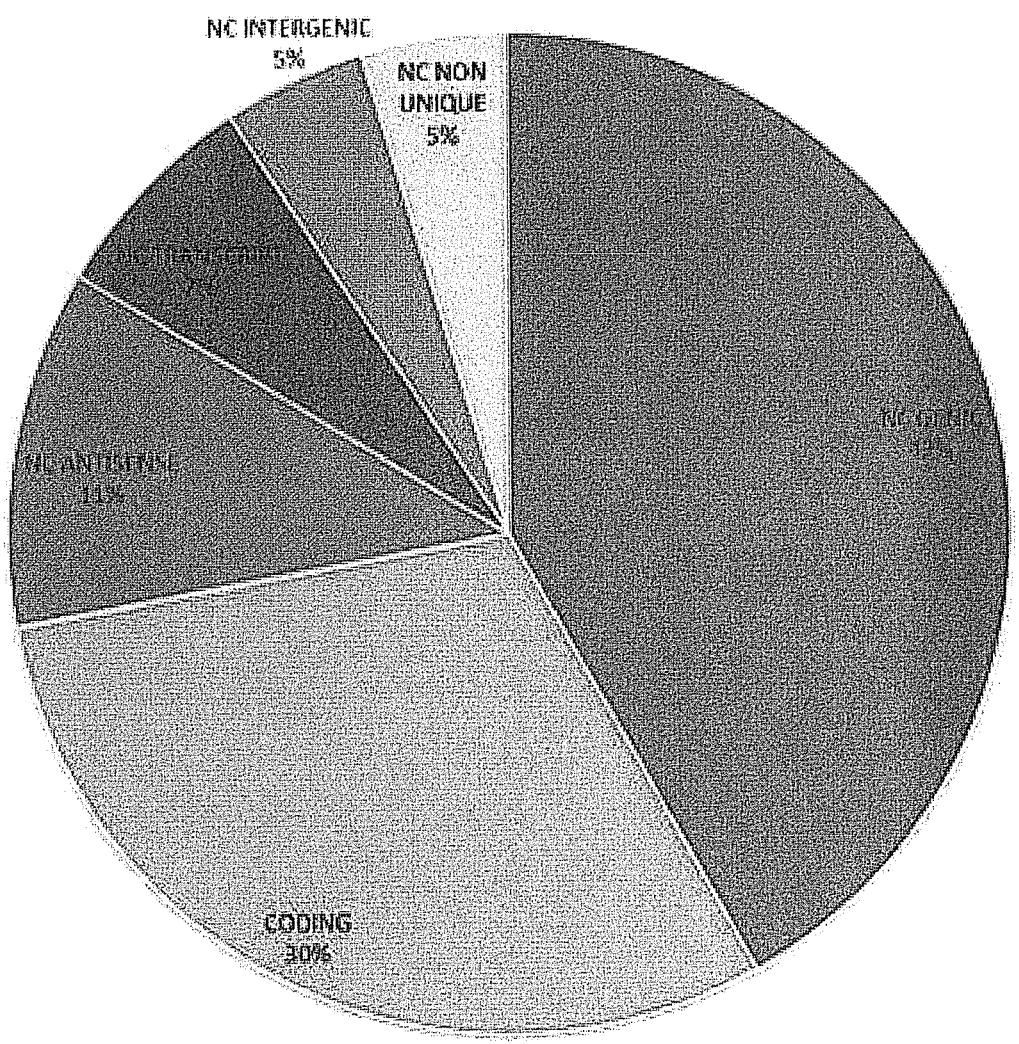
FIG. 4. PSR Annotation of the 43-Biomarker Set

We annotated the 43-biomarker set with labels described in Example 1 to identify the extent of non-coding features. We show the various labels within the 43-biomarker set in FIG. 4. Table 2 shows that most of the PSRs are found within the boundaries of a gene, with only one probe set (3802328) being intergenic. Assessment of the ontology term enrichment for the genes in Table 3 using DAVID tools shows that the set of genes is enriched, as expected in the case of cancer, for the biological processes of sister chromatid segregation, cell division and chromosome segregation (after Bonferroni correction, significance level of 0.08, Table 3).

TABLE 2

43-Biomarker Set. Chromosomal coordinates correspond to the hg19 version of the human genome. (Markers in the 43-biomarker set are annotated as RF43. Markers in the 22-biomarker set are annotated as RF22.)

| SEQ ID NO: | Biomarker Panel | Chromosome | Start | End | Category | Strand | Symbol | ENSEMBL ID |
|---|---|---|---|---|---|---|---|---|
| 1. | RF22, RF43 | 1 | 164790778 | 164790861 | CODING | 1 | PBX1 | ENSG00000185630 |
| 2. | RF22, RF43 | 12 | 102043061 | 102043198 | CODING | 1 | MYBPC1 | ENSG00000196091 |
| 3. | RF22, RF43 | 17 | 37054699 | 37054747 | CODING | 1 | LASP1 | ENSG00000002834 |
| 4. | RF22, RF43 | 1 | 20809088 | 20810189 | NON_CODING (CDS_ANTISENSE) | 1 | CAMK2N1 | ENSG00000162545 |
| 5. | RF22, RF43 | 9 | 125827478 | 125827705 | NON_CODING (CDS_ANTISENSE) | -1 | RABGAP1 | ENSG00000011454 |
| 6. | RF22, RF43 | 20 | 44445347 | 44445562 | NON_CODING (CDS_ANTISENSE) | -1 | UBE2C | ENSG00000175063 |
| 7. | RF22, RF43 | 5 | 14001862 | 14002003 | NON_CODING (ncTRANSCRIPT) | 1 | PCAT-32 | |
| 8. | RF22, RF43 | 9 | 14089154 | 14089187 | NON_CODING (INTRONIC) | -1 | NFIB | ENSG00000147862 |
| 9. | RF22, RF43 | 12 | 102021374 | 102021490 | NON_CODING (INTRONIC) | 1 | MYBPC1 | ENSG00000196091 |
| 10. | RF22, RF43 | 13 | 24157611 | 24158003 | NON_CODING (INTRONIC) | 1 | TNFRSF19 | ENSG00000127863 |
| 11. | RF22, RF43 | 4 | 30975279 | 30975441 | NON_CODING (INTRONIC) | 1 | PCDH7 | ENSG00000169851 |
| 12. | RF22, RF43 | 2 | 242138538 | 242138661 | NON_CODING (ncTRANSCRIPT) | 1 | ANO7 | ENSG00000146205 |
| 13. | RF22, RF43 | 11 | 58811043 | 58811070 | NON_CODING (ncTRANSCRIPT) | 1 | GLYATL1P4 | ENSG00000254399 |
| 14. | RF22, RF43 | 6 | 32330751 | 32331082 | NON_CODING (INTRONIC) | -1 | C6orf10 | ENSG000000206310 |
| 15. | RF22, RF43 | 1 | 156495410 | 156496002 | NON_CODING (UTR) | -1 | IQGAP3 | ENSG00000183856 |
| 16. | RF22, RF43 | 2 | 242163962 | 242164581 | NON_CODING (UTR) | 1 | ANO7 | ENSG00000146205 |
| 17. | RF22, RF43 | 6 | 169616207 | 169616770 | NON_CODING (UTR) | -1 | THBS2 | ENSG00000186340 |
| 18. | RF22, RF43 | 8 | 144939574 | 144939986 | NON_CODING (UTR) | -1 | EPPK1 | ENSG00000227184 |
| 19. | RF22, RF43 | 15 | 41672463 | 41672932 | NON_CODING (UTR) | 1 | NUSAP1 | ENSG00000137804 |
| 20. | RF22, RF43 | 15 | 66841241 | 66841800 | NON_CODING (UTR) | 1 | ZWILCH | ENSG00000174442 |
| 21. | RF22, RF43 | 19 | 3180095 | 3180328 | NON_CODING (UTR) | 1 | S1PR4 | ENSG00000125910 |
| 22. | RF22, RF43 | 20 | 44445472 | 44445507 | NON_CODING (UTR) | 1 | UBE2C | ENSG00000175063 |
| 23. | RF43 | 3 | 101212717 | 101212786 | CODING | -1 | SENP7 | ENSG00000138468 |
| 24. | RF43 | 7 | 36450679 | 36450750 | CODING | 1 | ANLN | ENSG00000011426 |
| 25. | RF43 | 10 | 88730269 | 88730288 | CODING | 1 | C10orf116 | ENSG00000148671 |
| 26. | RF43 | 11 | 68382513 | 68382688 | CODING | 1 | PPP6R3 | ENSG00000110075 |
| 27. | RF43 | 13 | 33327527 | 33327656 | CODING | 1 | PDS5B | ENSG00000083642 |
| 28. | RF43 | 17 | 38552572 | 38552698 | CODING | -1 | TOP2A | ENSG00000131747 |
| 29. | RF43 | 3 | 190366433 | 190366480 | CODING | 1 | IL1RAP | ENSG00000196083 |
| 30. | RF43 | 4 | 104057451 | 104057507 | CODING | -1 | CENPE | ENSG00000138778 |
| 31. | RF43 | 12 | 4854600 | 4854755 | CODING | 1 | GALNT8 | ENSG00000130035 |
| 32. | RF43 | 17 | 38555314 | 38555364 | CODING | -1 | TOP2A | ENSG00000131747 |
| 33. | RF43 | 11 | 2772266 | 2772592 | NON_CODING (CDS_ANTISENSE) | -1 | KCNQ1 | ENSG00000053918 |
| 34. | RF43 | 18 | 24237326 | 24237436 | NON_CODING (INTERGENIC) | -1 | | |
| 35. | RF43 | 6 | 72119721 | 72119751 | NON_CODING (INTRONIC) | -1 | C6orf155 | ENSG00000233237 |
| 36. | RF43 | 11 | 24997429 | 24997706 | NON_CODING (INTRONIC) | 1 | LUZP2 | ENSG00000187398 |
| 37. | RF43 | 12 | 102030525 | 102030872 | NON_CODING (INTRONIC) | 1 | MYBPC1 | ENSG00000196091 |
| 38. | RF43 | 16 | 50104059 | 50104087 | NON_CODING (INTRONIC) | 1 | HEATR3 | ENSG00000155393 |
| 39. | RF43 | 3 | 132829328 | 132829491 | NON_CODING (INTRONIC_ANTISENSE) | -1 | TMEM108 | ENSG00000144868 |

TABLE 2-continued

43-Biomarker Set. Chromosomal coordinates correspond to the hg19 version of the human genome. (Markers in the 43-biomarker set are annotated as RF43. Markers in the 22-biomarker set are annotated as RF22.)

| SEQ ID NO: | Biomarker Panel | Chromosome | Start | End | Category | Strand | Symbol | ENSEMBL ID |
|---|---|---|---|---|---|---|---|---|
| 40. | RF43 | 6 | 31914455 | 31914576 | NON_CODING (ncTRANSCRIPT) | 1 | CFB XXbac-BPG116M5.17 | ENSG00000243649 ENSG00000244255 |
| 41. | RF43 | 7 | 5967689 | 5967716 | NON_CODING (NON_UNIQUE) | 1 | | |
| 42. | RF43 | 1 | 53379570 | 53379755 | NON_CODING (UTR) | -1 | ECHDC2 | ENSG00000121310 |
| 43. | RF43 | 11 | 13376793 | 13376832 | NON_CODING (UTR) | 1 | ARNTL | ENSG00000133794 |

TABLE 3

Gene Ontology Terms Enriched in the 43-Biomarker Signature

| GO Term | Biological Process | Genes Involved | P-value | Adjusted P-value |
|---|---|---|---|---|
| GO: 0000819 | Sister Chromatid Segregation | CENPE, NUSAP1, PDS5B, TOP2A | 6.99E-05 | 0.0736 |
| GO: 0051301 | Cell Division | ANLN, CENPE, NUSAP1, PDS5B, UBE2C, ZWILCH | 7.04E-05 | 0.074 |
| GO: 0007059 | Chromosome Segregation | CENPE, NUSAP1, PDS5B, TOP2A | 7.27E-05 | 0.0765 |

The set of probe sets reported here is rich in novel information for prostate cancer prognosis, as most of the probe sets fall in non-coding regions suggesting that non-coding RNAs may constitute a set of highly informative markers for prostate cancer.

Figure 5:
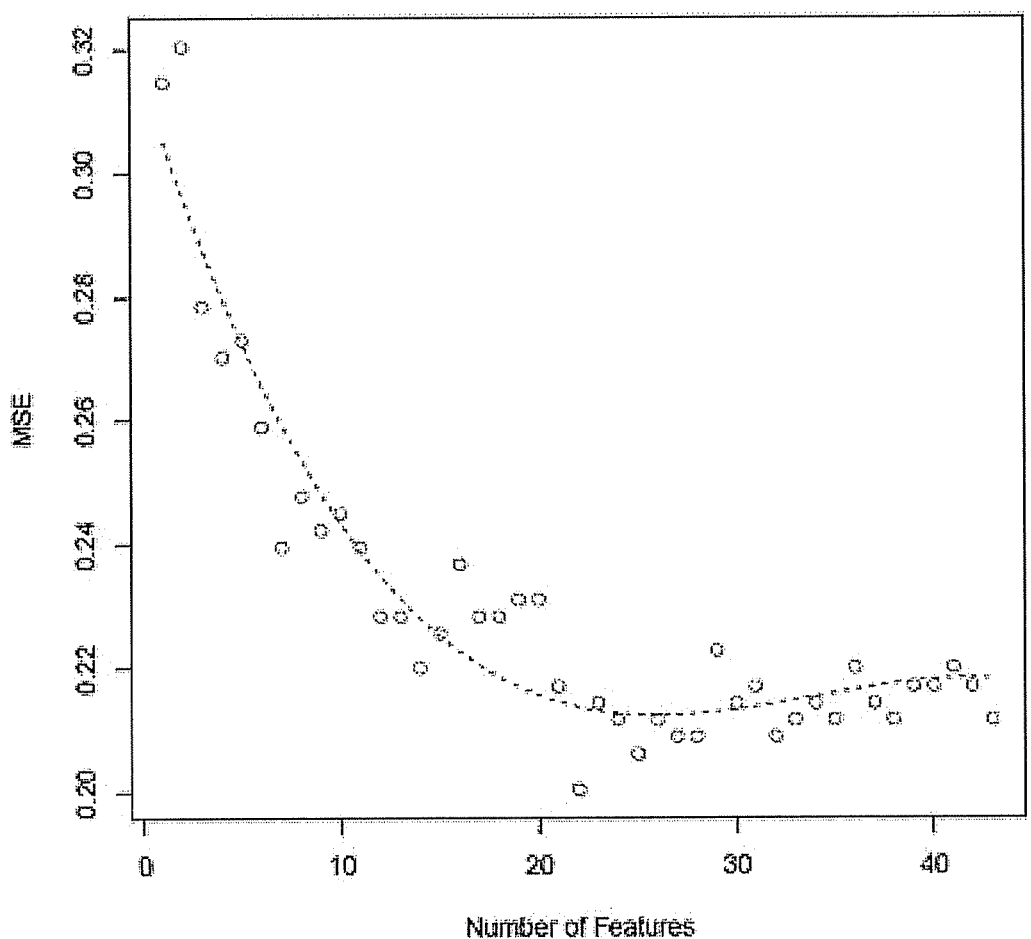
FIG. 5. Biomarker variable mean squared error for selection of 22-biomarker signature FIGS. 6A-B. Biomarker signature variable importance plot FIG. 7. Development of Genomic Classifier (GC).
Figure 6:
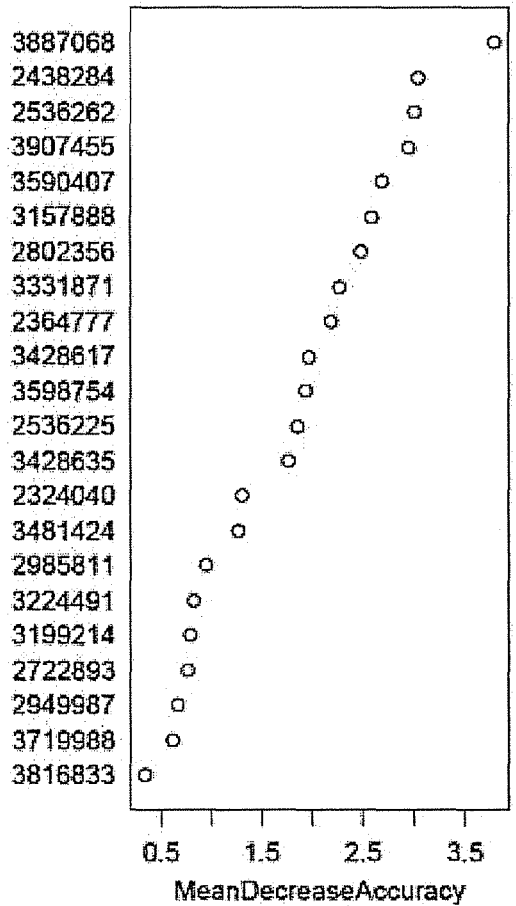
Figure 6:
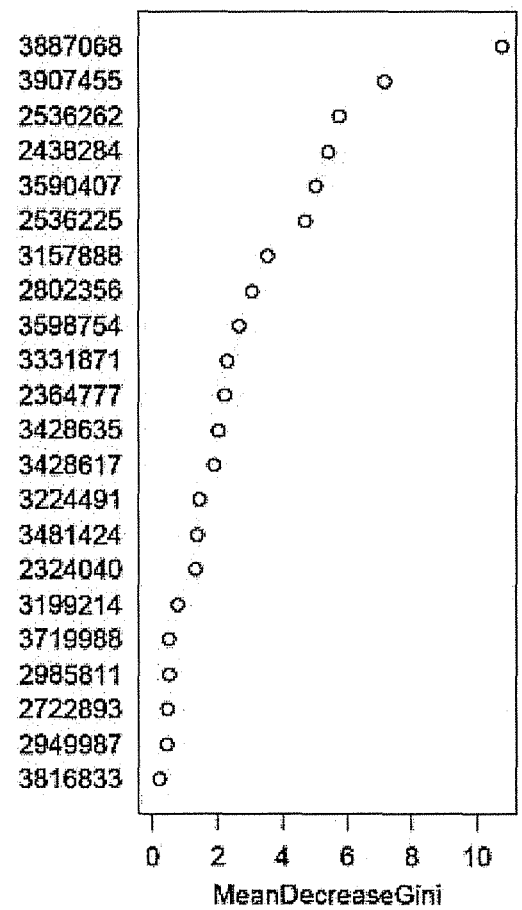
Figure 7:
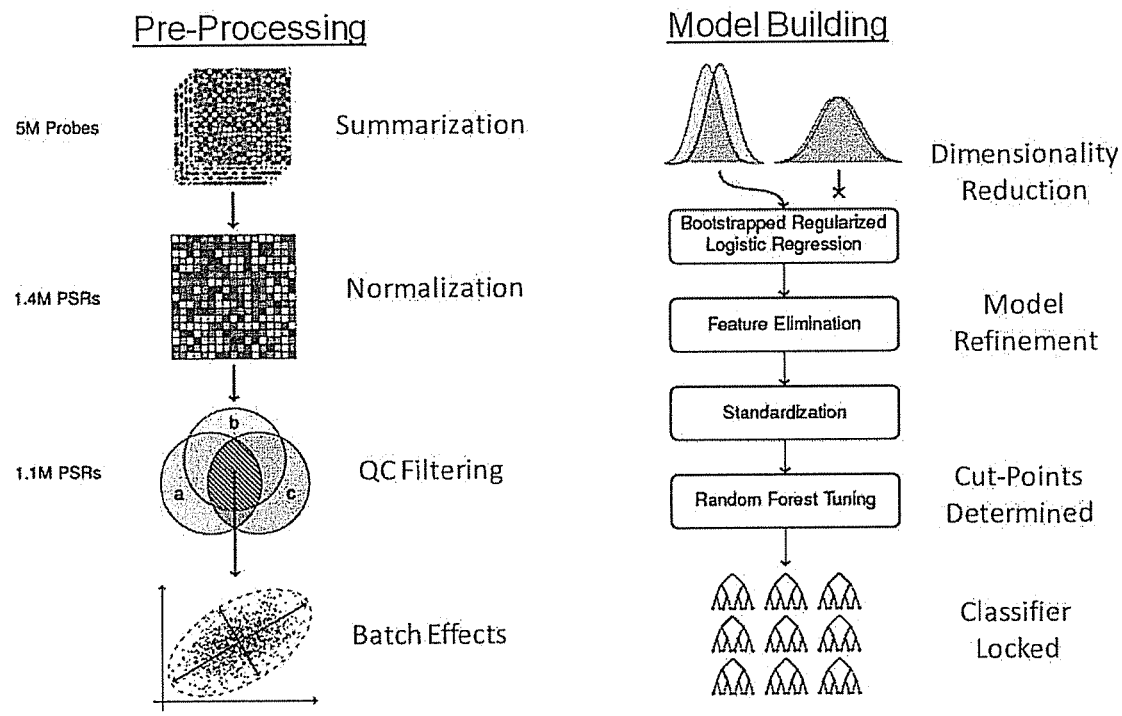

Example 3: A 22-Biomarker Signature for Prostate Cancer and Comparison to Clinical and Integrated Models To further ensure robustness of the features in the signature, we applied a final filtration method that would establish the minimal number of features required to minimize the mean squared error (MSE) of the model. To do this we used the rfcv function from the randomForest package, using 10-fold cross validation and a step value of 0.9. This method will order the features in accordance to their variable importance and iteratively remove 10% of lowest ranking features and measure the MSE at each step. We selected the number of features that were at the knee of the curve, shown in FIG. 5. At all features to the left of this knee have a highly variable MSE, which becomes more stable to the right of the knee of the curve. The knee of the curve occurs at approximately 22 features. FIG. 6 calculated the variable importance by ranking the features according to their mean decrease in accuracy (MDA) and mean decrease in gini (MDG). Some features have low MDA and MDG, which may warrant their removal from the marker set, however FIG. 5 shows that the inclusion of even some of the less differentiating features still contributed to a lower MSE. An overview of the feature selection and microarray methods is shown in FIG. 7.

Classifier Development

We developed three classifiers using the aforementioned 22 features, clinicopathologic variables, and a combination of both. We referred to the classifiers as the genomic classifier (GC), clinical classifier (CC) and integrated genomic clinical classifier (GCC); they are described in detail below. The primary endpoint for classifier development was the METS event. Although it is typical to report probabilities of progression at 2, 5, 7 or 10 years after METS, the design of the discovery study prevents us from reporting probabilities that are meaningful outside of study. For this reason, the scores for all of the aforementioned models prognosticate whether a given individual will experience metastatic disease progression, as this endpoint is not subject to modeling disease prevalence or time to an event but rather the presence or absence of features that indicate disease aggression.

Genomic Classifier (GC)

A total of 22 features were used for model building. As a further method of standardization, the expression values for the 22 features were percentile ranked for each patient. We used a random forest from the randomForest package available in R for model building and used the tune function, from the e1071 package, to identify the optimal model parameters; the optimal parameters were established to be: nodesize=80, ntree=700, mtry=15. The tuning parameters were selected to optimize classification accuracy in the training set. The model built from the training data is frozen and stored for future application to novel data. The model for classification built from the 22-biomarker feature set is henceforth referred to as the genomic classifier (GC) when applied to novel data. Notable, the final feature set (Table 4) is such that most of the 22 features in GC were ncRNA and only three were from protein-encoding mRNA (Table 4).

The GC outputs a score between [0,1], where 1 indicates higher metastatic potential. The score is derived as an output of the random forest, and rather than representing a probability it represents the total percentage of the trees in the forest that classified a new case as METS. Alternatively, it may also be said that each decision tree within the random forest decides whether the expression levels of the 22 features in a given tumor sample is more representative of MET disease or not. We used a 0.5 cutoff to classify patients as having METS or not because it is objective and used the simple Majority rule logic.

Clinical Classifier (CC)

A clinical classifier (CC) for predicting the METS end point was developed using the following clinicopathologic variables: Lymph node invasion status (LNI); Surgical Margin Status (SMS); Seminal Vesicle Invasion (SVI); Extra Capsular Extension (ECE); Pathological Gleason Score; and the pre-operative PSA. The first four clinical variables (LNI, SMS, SVI and ECE) are used as binary variables, indicating present or not; the pre-operative PSA values are taken to log 10. The clinical variables were assembled in a logistic regression and the trained model was used to predict METS in the testing set and validation study. CC produces a probability between 0 and 1, where 0 indicates low metastatic potential and 1 indicates a high metastatic potential.

made it possible to quantify the difference additional genomic information provided in risk prediction.

Genomic Clinical Classifier (GCC)

The GC scores were assembled along with clinicopathologic variables used for CC using a logistic linear regression

TABLE 4

22-Biomarker Set. Chromosomal coordinates correspond to the hg19 version of the human genome.

| Gene | Cyt. Band | # Markers | Annotation of Markers | Biology | Differential Expression mets vs Non-mets |
|---|---|---|---|---|---|
| CAMK2N1 | 1p36.12 | 1 | CODING AS | Cell Cycle Progression/ Control Of Signaling Pathway | Upregulated |
| IQGAP3 | 1q23.1 | 1 | 3' UTR | Cell Proliferation/ Control Of Signaling Pathway | Upregulated |
| PBX1 | 1q23.3 | 1 | CODING | Proto-Oncogene/ Transcription Factor/ Immune Response | Downregulated |
| ANO7 | 2q37.3 | 2 | 3' UTR/ncTRANSCRIPT** | Cell Adhesion | Downregulated |
| PCDH7 | 4p15.1 | 1 | INTRONIC | Cell Adhesion | Downregulated |
| PCAT-32 | 5p15.2 | 1 | ncTRANSCRIPT | ncRNA DIFFERENTIALLY EXPRESSED IN PROSTATE CANCER | Downregulated |
| TSBP | 6p21.32 | 1 | INTRONIC | Testis-Specific Basic Protein/ Immune Response | Downregulated |
| THBS2 | 6q27 | 1 | 3' UTR | Cell-Cell, Cell-Matrix Interaction/ Modulator Of Angiogenesis | Upregulated |
| EPPK1 | 8q24.3 | 1 | 3' UTR | Cytoskeleton Maintenance In Epithelial Cells | Upregulated |
| NFIB | 9p23 | 1 | INTRONIC | Cell Proliferation/ Transcription Factor | Downregulated |
| RABGAP1 | 9q33.2 | 1 | CODING AS | Cell Cycle Progression/ Microtubule Nucleation | Upregulated |
| GLYATL1P4 | 11q12.1 | 1 | ncTRANSCRIPT | Pseudogene | Downregulated |
| MYBPC1 | 12q23.2 | 2 | CODING/INTRONIC | Epithelial Cell Protein | Downregulatec |
| TNFRSF19 | 13q12.12 | 1 | INTRONIC | Type I Cell Surface Receptor/Control Of Signaling Pathway | Downregulated |
| NUSAP1 | 15q15.1 | 1 | 3' UTR | Cell Cycle Progression/ Microtubule Stabilization | Upregulated |
| ZWILCH | 15q22.31 | 1 | 3' UTR | Cell Cycle Progression/ Chromosome Segregation | Upregulated |
| LASP1 | 17q12 | 1 | CODING | Cell Proliferation/ Cytoskeletal-Associated Protein | Upregulated |
| S1PR4 | 19p13.3 | 1 | 3' UTR | Cell Differentiation | Upregulated |
| UBE2C | 20q13.12 | 2 | 3'UTR/CODING AS | Cell Cycle Progression | Upregulated |

The motivation for developing the CC was to compare the GC and GCC (described below) against a prognostic model that was developed for a similar endpoint. As the majority of post-operative nomograms prognosticate BCR in an "all-comers" population, we felt it was necessary to compare GC and GCC against a nomogram based on a high-risk population with the METS endpoint. The CC served as an intermediate benchmark between the GC and GCC and model fitted to the training data. The combined GC and CC model is referred to as Genomic Clinical Classifier (GCC).

Comparison to Nakagawa 17-Gene Signature

This discovery cohort was previously profiled using the Illumina DASL expression microarray (Cancer Panel v1) containing 502 oncogenes, tumor suppressors genes and genes in their associate pathways. Nakagawa (2008) describes the development of a 17 gene signature to predict METS (referred to as systemic progression in that text). We translated the 17 gene signature from the DASL platform to the HuEx platform and re-modeled those genes in the training set using logistic regression. We compare the performance of the 17-gene signature against GC, CC and GCC.

We found that in both training and testing, GC, CC and GCC outperformed the 17-gene signature (and also the GPSM nomogram); the AUC results are summarized in Table 5.

TABLE 5

Comparison of Discrimination ability of classifiers in different datasets

| Model | Training | Testing | Validation* |
|-------|----------|---------|-------------|
| GC    | 0.90     | 0.76    | 0.79        |
| GCC   | 0.90     | 0.75    | 0.82        |
| CC    | 0.76     | 0.70    | 0.70        |
| GPSM  | 0.71     | 0.62    | 0.59        |
| DASL17 | 0.73    | 0.60    | 0.64        |

*Survival ROC analysis was used for case-cohort validation study

Statistical Analysis

The CC, GC and GCC prediction models were evaluated in the independent validation cohort and compared to the GPSM scores for predicting the primary endpoint of mets. Researchers at GenomeDx were blinded to the outcomes and the initial analysis was conducted by Mayo Clinic statisticians (RC and EJB). C discrimination index (c-index), an extension of the area under the ROC curve for the case of censored survival data was used to initially compare the performance of each model to predict mets. The 95% confidence intervals for the c-index were approximated through bootstrapping.

Following de-blinding, several additional analyses were performed. Calibration plots, survival ROC, and decision curves were used to assess overall discrimination. Decision curve analysis was used to compare the net benefit (e.g., the gain in sensitivity weighted by a loss in specificity) over a range of 'decision-to-treat' threshold probabilities using the clinical-only vs. genomic models. Survival ROC and decision curves were evaluated for prediction of mets within 5 years after RP. Graphical diagnostic, ROC-based, and Censored data methods were used to determine a tentative cut-off for GC on the discovery set.

Cox proportional hazards regression analysis was used to test for associations between models and the mets endpoint. Proportional hazards assumptions of the Cox model were confirmed by evaluating the scaled Schoenfeld residuals. Due to the case-cohort design of the validation study, survival analysis utilized the Lin-Ying method, weighting the controls to reflect mets incidence in the cohort at large. Cumulative incidence curves were constructed using competing risks analysis to accommodate censoring due to death, and other events, which bias Kaplan-Meier estimates of incidence. CC, GC and GCC models were subdivided into tertiles as an objective demarcation of low, intermediate and high risk groups. The GPSM score risk groups were defined previously.

Analyses were performed using R v 2.14.1 (www.R-project.org). All tests were two-sided and a Type I error probability of 5%. The study was approved by the Mayo Clinic Institutional Review Board.

Biomarker Evaluation
Independent Validation of Prognostic Classifiers

Figure 8:
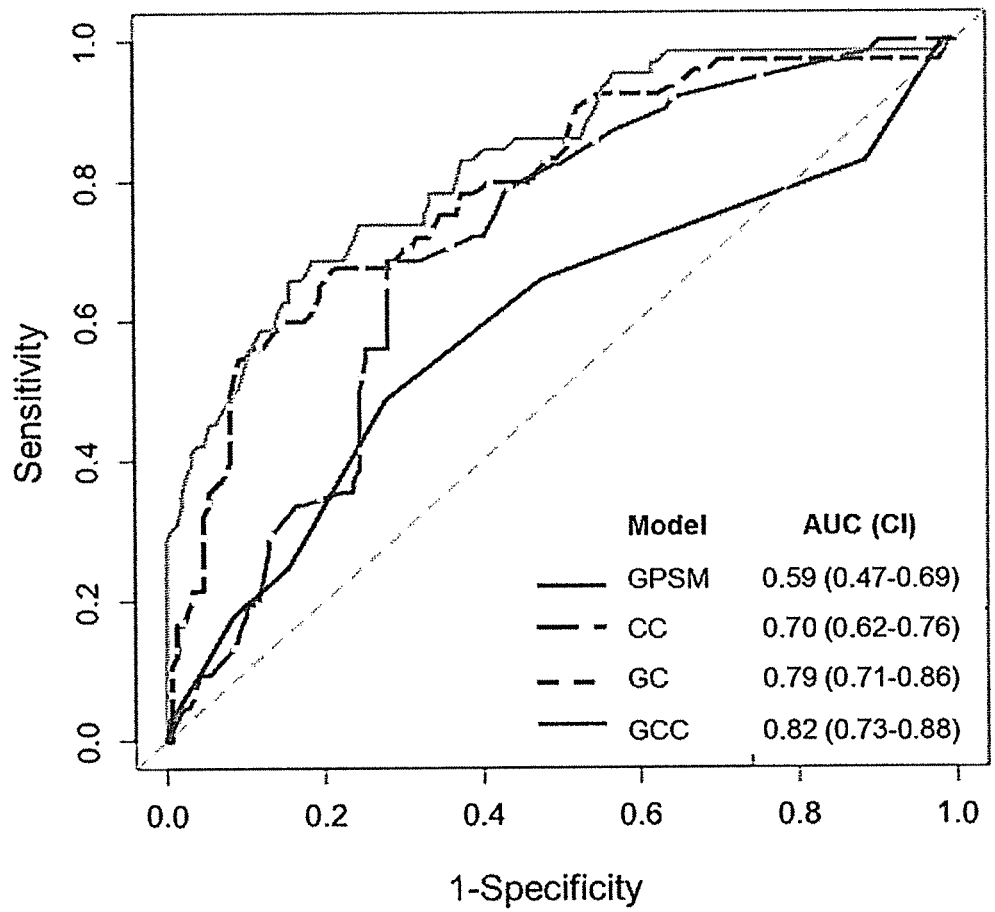
FIG. 8. Survival ROC to compare the accuracy of predicting metastatic disease (METS) at 5 years in different models. Survival ROC evaluates the ability of a marker measured at baseline (in this case RP) to discriminate between patients who develop CP from those who do not over a follow-up interval of 5 years. C discrimination index with 95% confidence intervals are shown for each prognostic classifier.

In a blinded-independent validation study, 5-year survival ROC curves for metastasis-free end point showed a c-index of 0.70 and 0.59 for CC and GPSM, respectively (FIG. 8). GC outperformed these clinicopathologic prediction models with a c-index of 0.79, which increased to 0.82 in the integrated GCC model. In addition, the 95% confidence intervals (CIs) of the genomic models overlapped extensively, indicating comparable predictive performances (FIG. 8).

Figure 9:
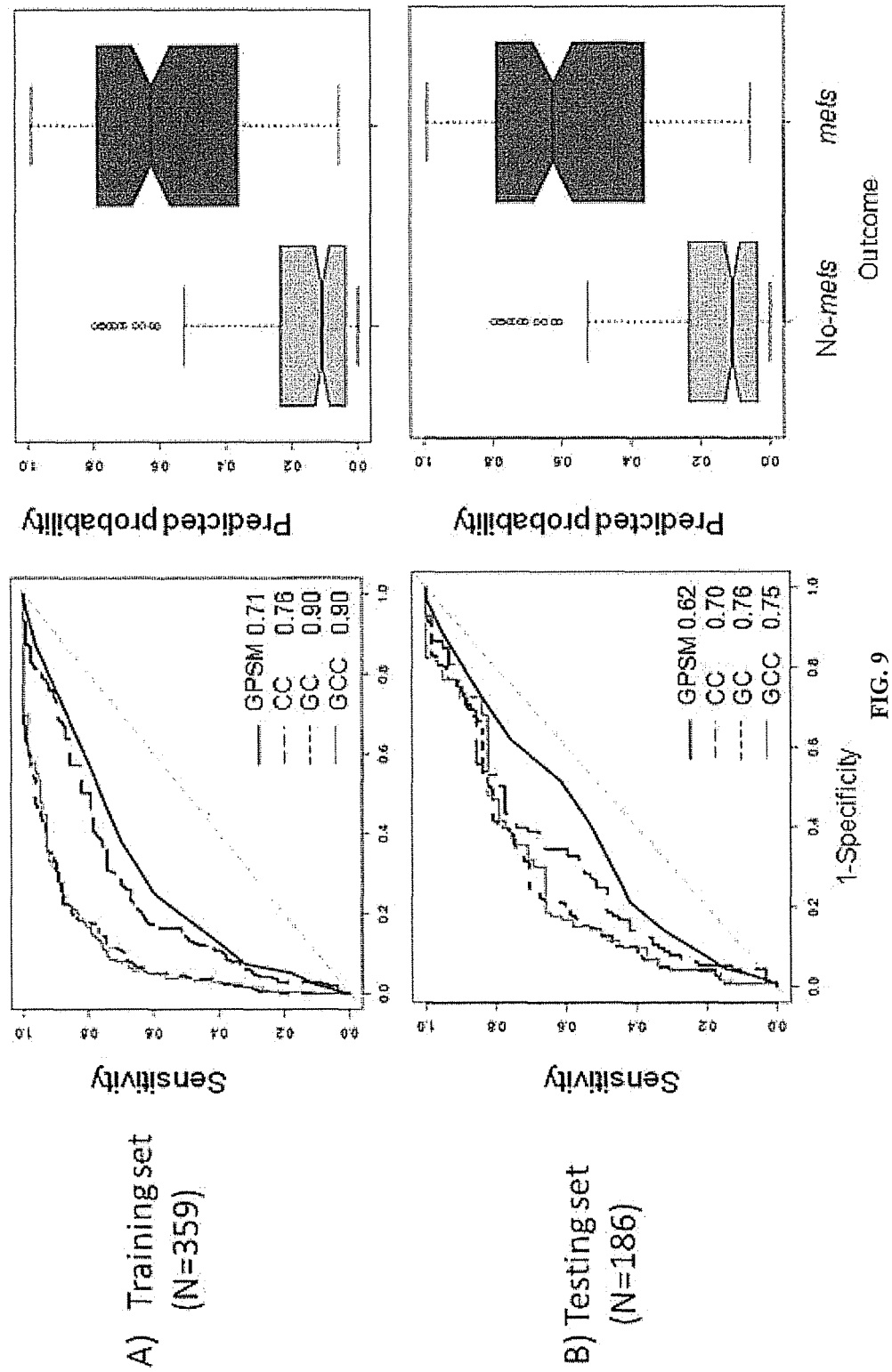
FIGS. 9A-B. Standard ROC and Discrimination plot for GC, CC and GCC.
Figure 10:
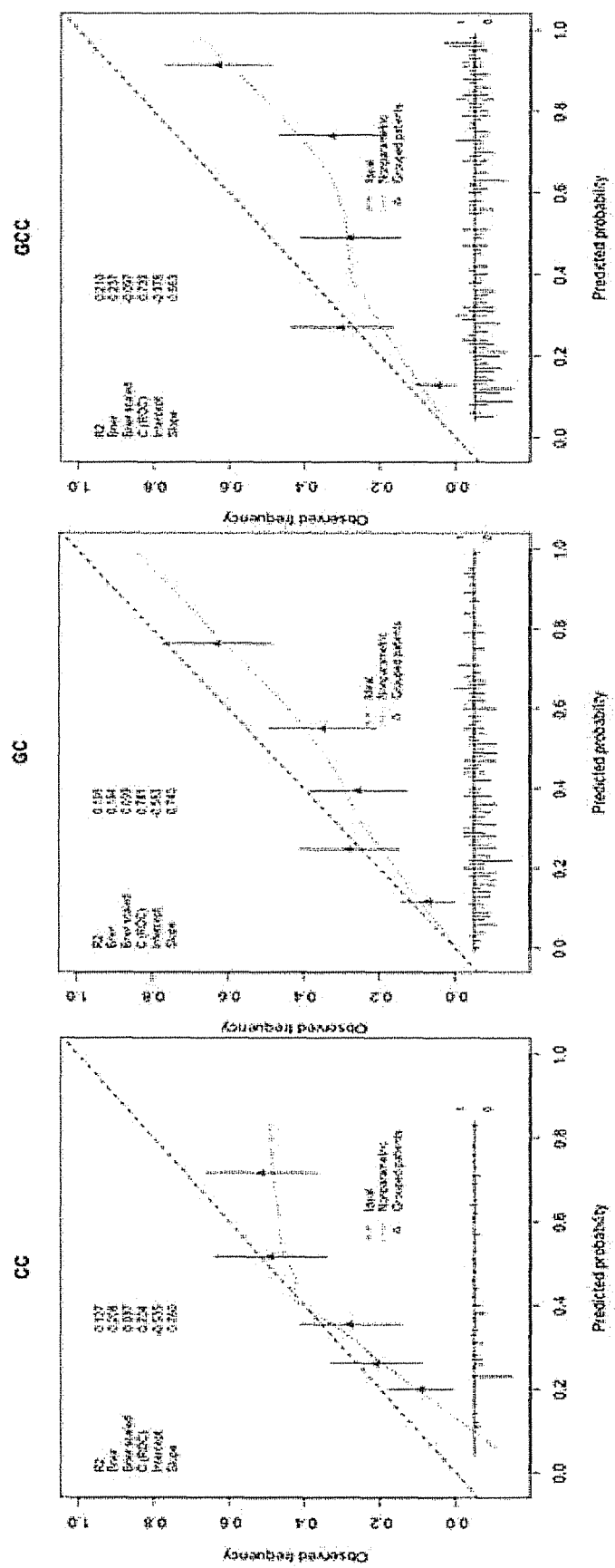
FIG. 10. Calibration plots for probability of METS
Figure 11:
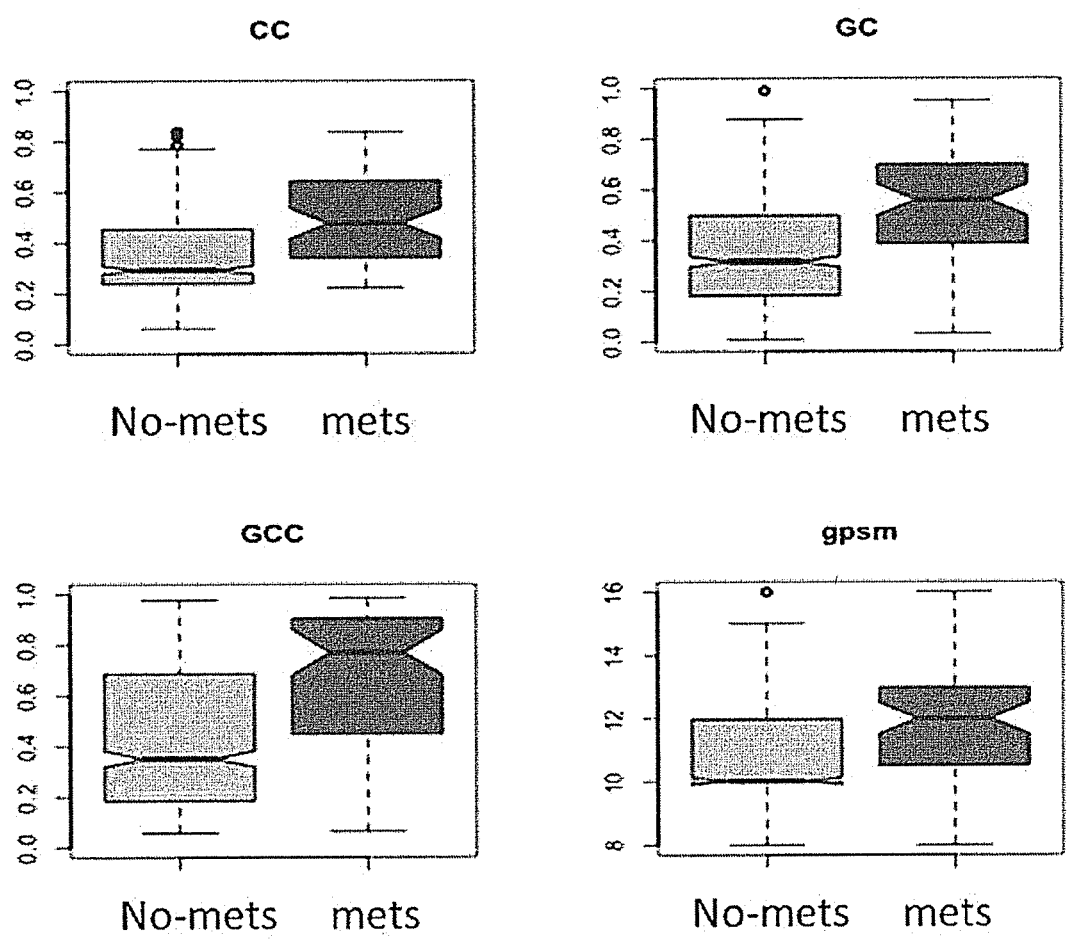
FIG. 11. Discrimination plots for CC, GC, and GCC models (for METS)

Moreover, discrimination box-plots and calibration curves show the improved performance for classifiers that used the genomic variables over clinicopathologic models (CC and GPSM) (FIGS. 9-11).

Figure 12:
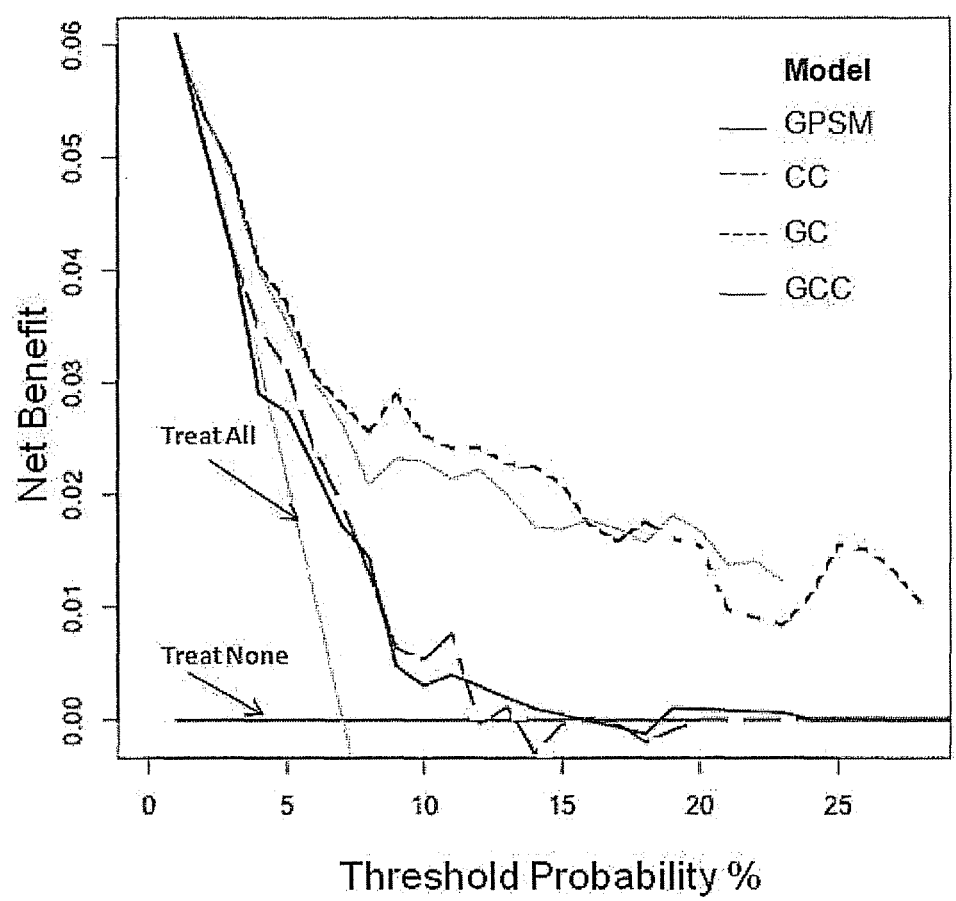
FIG. 12. Survival decision curve analysis for the prognostic models at 5 years following radical prostatectomy. Performance of models is compared to extremes of classifying all patients as CP (thus potentially treating all patients, light gray line), against classifying no patients as CP (this treating none, horizontal dark gray line). A decision-to-treat threshold is a cutoff used to classify a patient as having CP or not. In decision curve analysis, this threshold varies from 0 to 1, and the sensitivity and specificity are calculated at each threshold, to determine the net-benefit. A model with a high net-benefit that does not overlap the "Treat All" line is optimal. The x-axis is the threshold probabilities while the y-axis is the net-benefit.

A decision curve comparing the models is shown in FIG. 12. At 'decision-to-treat' threshold probabilities (e.g., probability of metastatic disease at 5 years after RP), ranging from 5-25%, the net benefit of the genomic-based models exceeded that of both clinical-only models. Collectively, these data imply that the genomic panel significantly improves predictive ability.

Figure 13:
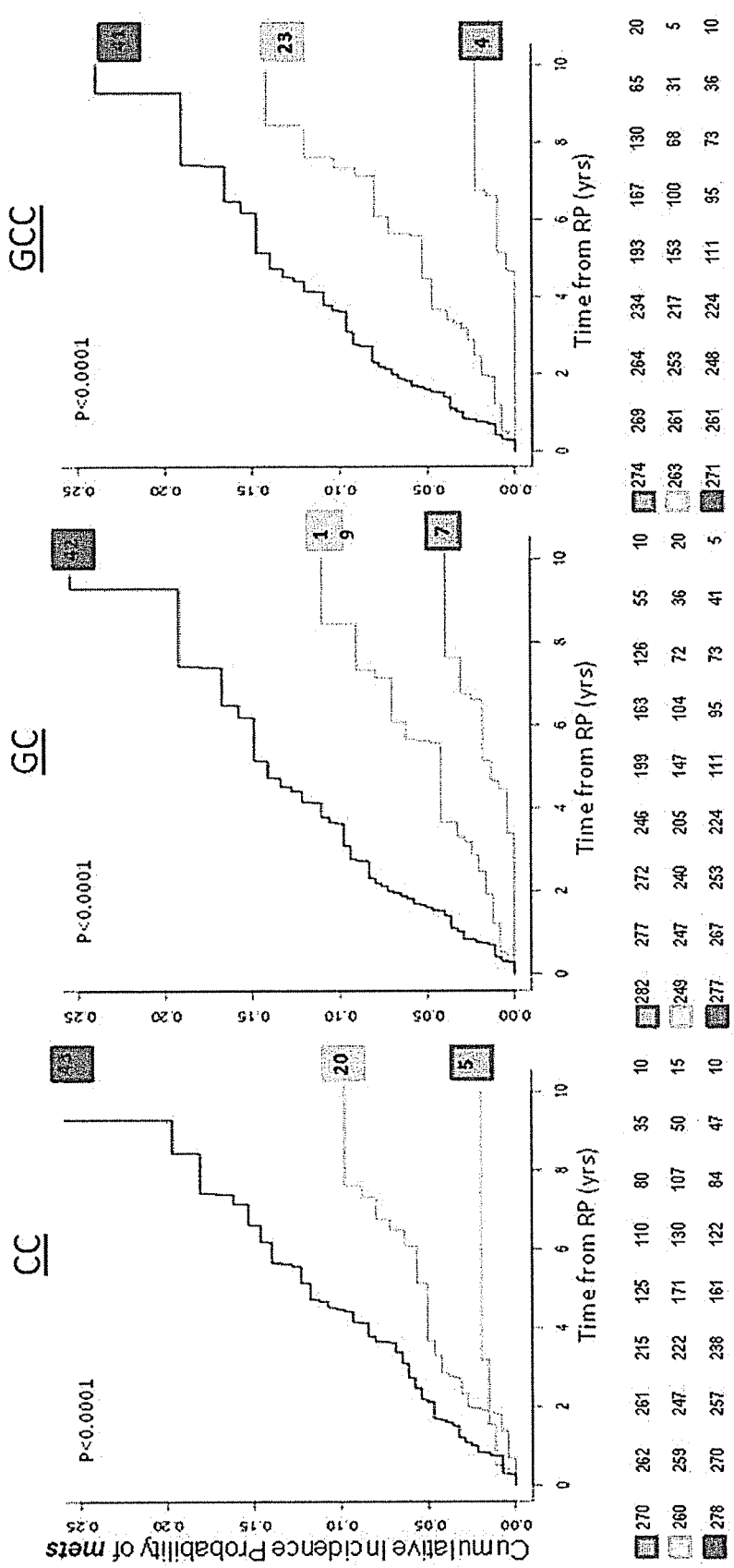
FIG. 13. Comparison of CC, GC and GCC cumulative Incidence (for METS)
Figure 16:
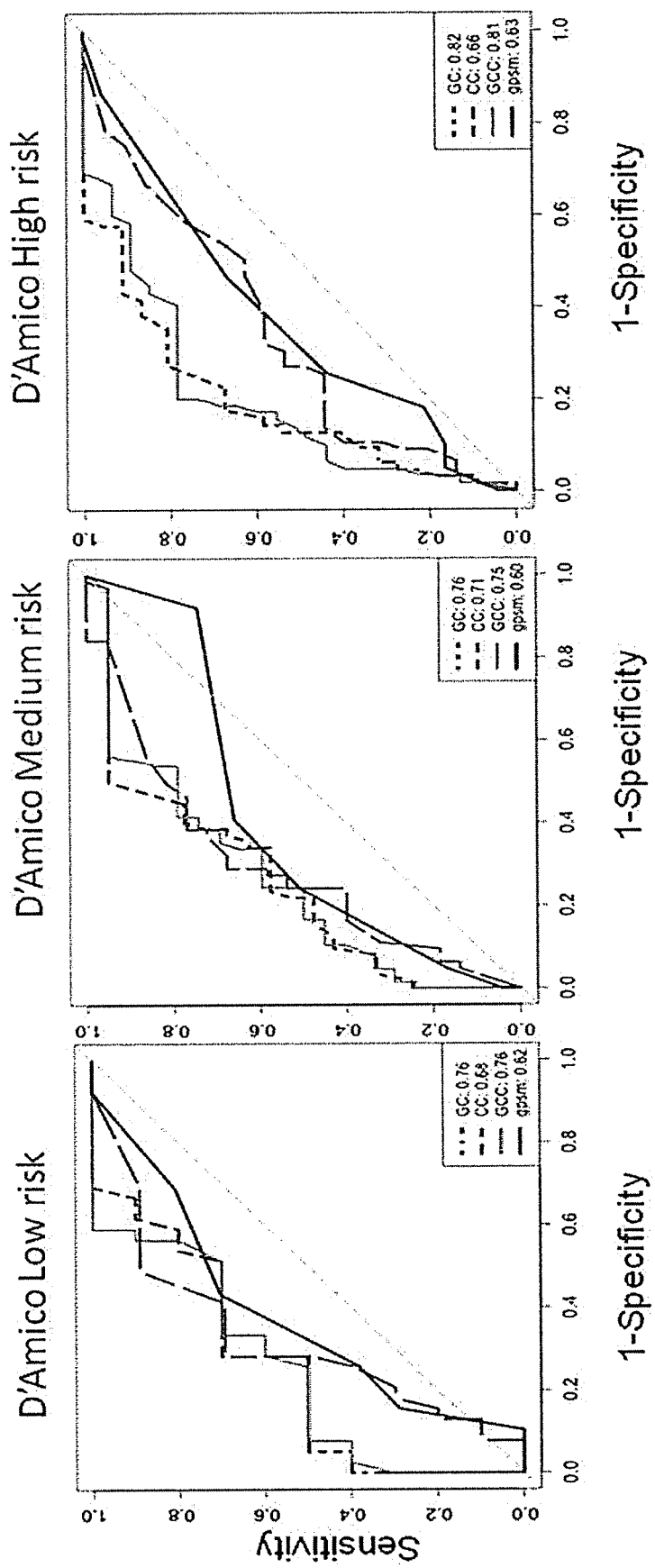
FIG. 16. 5-year metastasis-free survival ROC in sampled validation study
Figure 17:
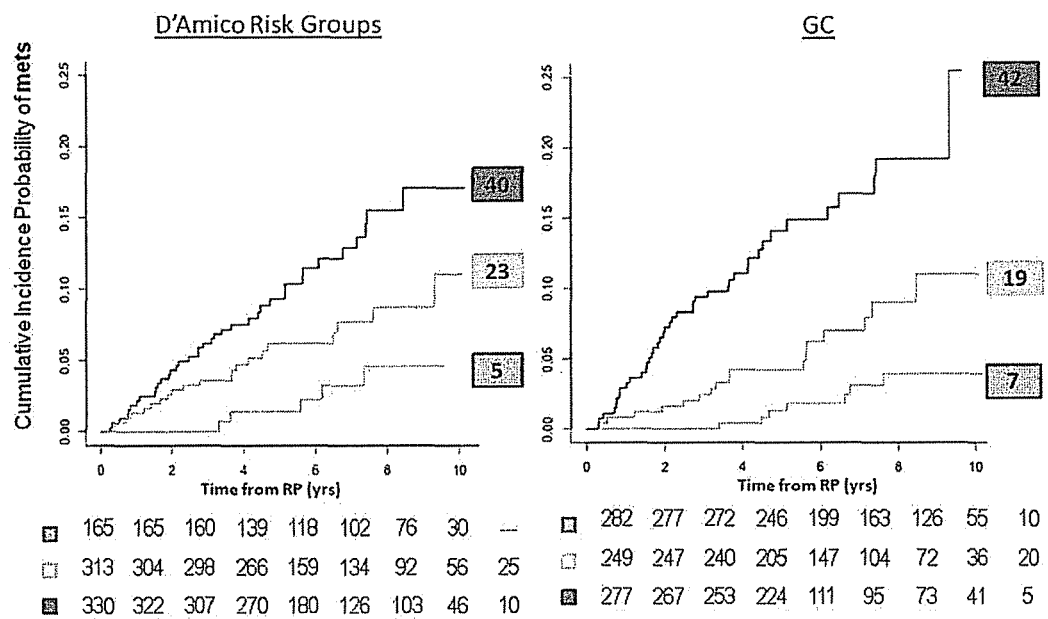
FIG. 17. Cumulative Incidence: D'Amico and GC

Cumulative incidence plots compared the incidence of mets events in the risk groups for each model (FIG. 3). Difference in cumulative incidence between risk groups defined by GC tentative cut-off was highly significant for GC (p<0.001), with the group below the 0.5 potential cut-off having an incidence of <2.5% at 5-years post RP, and the group equal or above the cut-off had 5-year post RP cumulative incidence of ~18%. However, after using a prior cut-off for GPSM, the risk groups were not significantly different (p=0.35). We also compared cumulative incidence plots of mets events between tertiles for each model (FIG. 13, 14, 15). In order to assess the performance of the models in a different categorization of risk groups, we used the D'Amico definition of low, intermediate and high risk patients (FIGS. 16, 17). Based on this, ~60% of our high-risk cohort falls under the definitions of low and intermediate risk patients as defined by D'Amico as low or intermediate.

Figure 14:
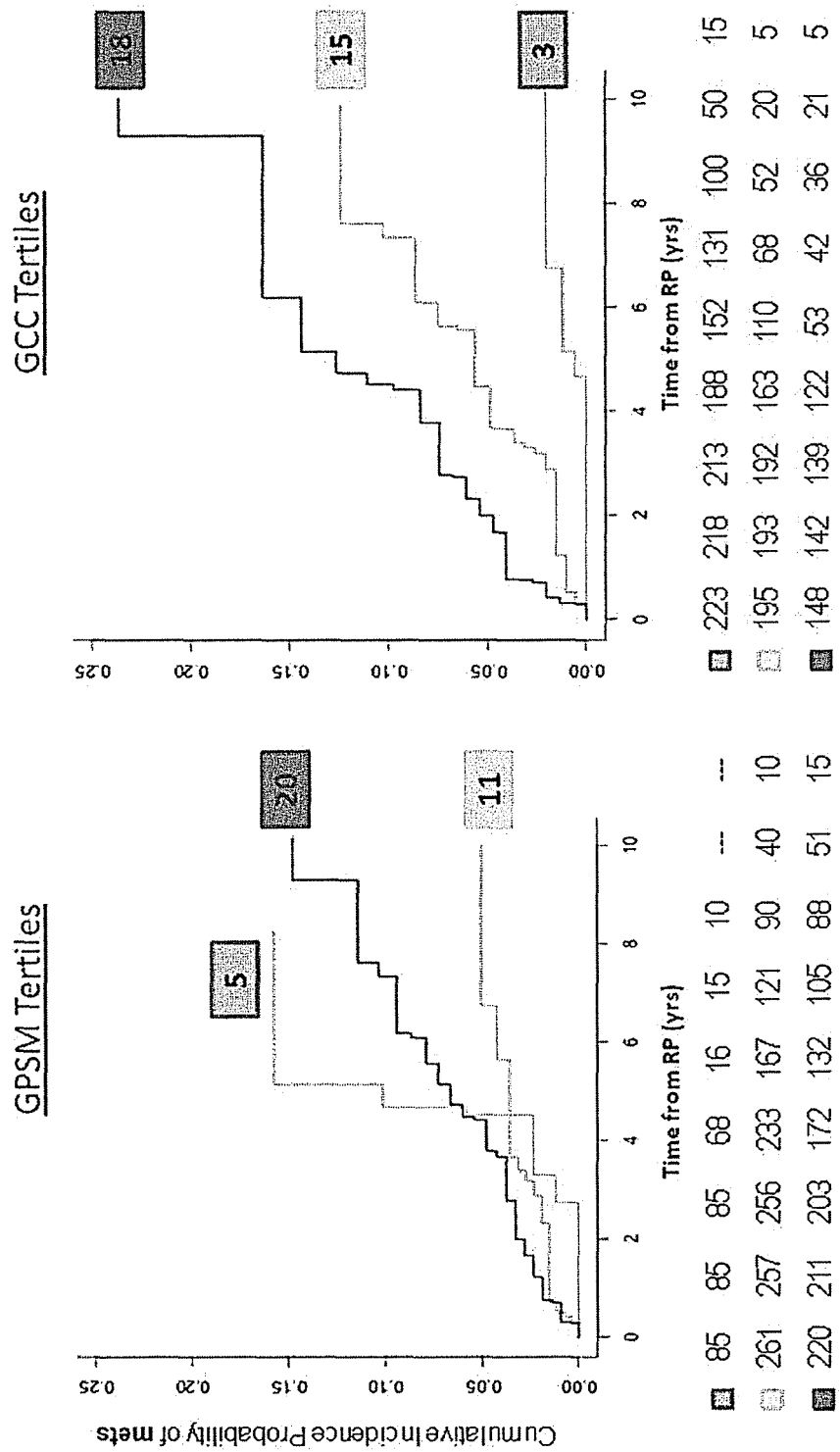
FIG. 14. Cumulative incidence removing patients with adjuvant hormones: GPSM and GCC FIG. 15. Cumulative incidence removing patients with adjuvant hormones: GPSM and GC.
Figure 15:
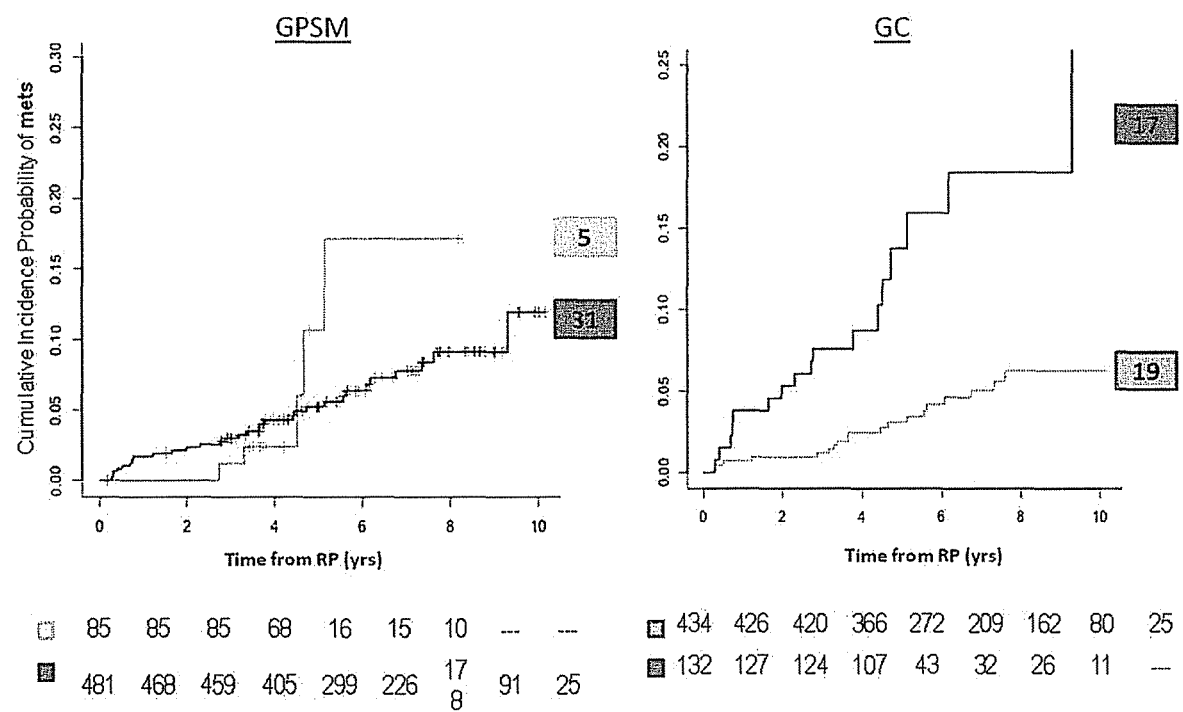

Difference in cumulative incidence between tertiles was highly significant for GCC (p<0.001), with the 1st tertile group having an incidence of <1% at 5-years post RP and only three cases of mets (which all occurred >5 years post RP). The 2nd tertile had 5-year post RP cumulative incidence of 5% (less than the 7.5% rate in the full cohort) and the 3rd tertile GCC group had 44 mets events, with 5-year incidence of ~15%. In addition, the majority of patients in the 3rd GCC tertile experienced mets within 3 years of RP. The cumulative incidence differences between tertiles were also significant for both GC and CC models (FIG. 13). The GPSM, and GC groups defined by their pre-determined cut-offs, and GPSM and GCC groups defined by tertiles were also compared when patients who received adjuvant androgen deprivation therapy were excluded from the analysis, and GC and GCC groups were significantly different (FIGS. 14-15).

Figure 18:
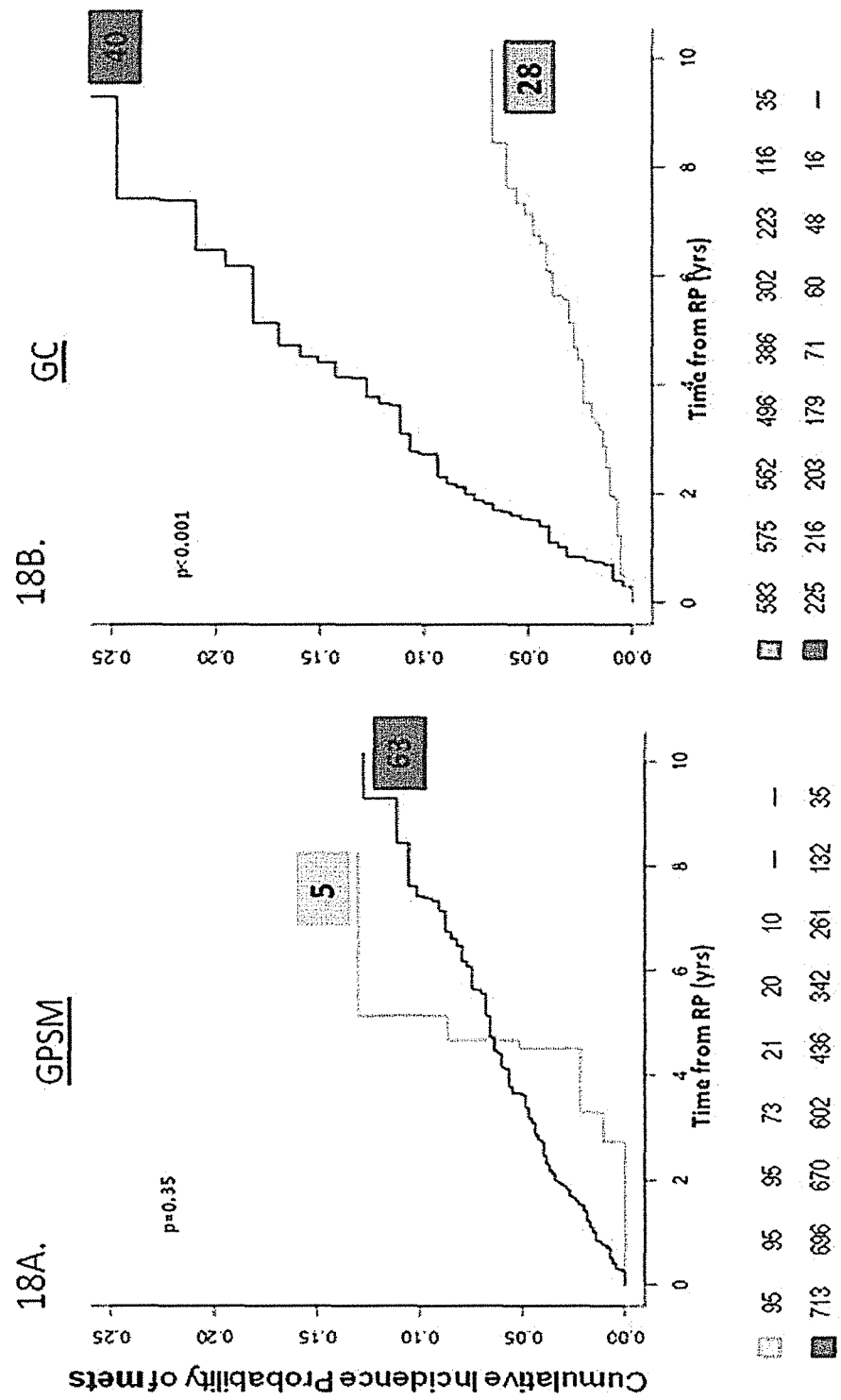
FIGS. 18A-B. Cumulative incidence of GPSM and GC groups. A) Patients are segregated into low (<5), intermediate (5-9) and high risk (≥10) GPSM groups as suggested in Thompson et al. B) GC scores were segregated into low (<0.5) and high (>=0.5) for tentative risk groups. Irrespective of the method used, red lines indicated higher risk, orange intermediate risk and green lower risk. Number of patients (weighting controls by a factor of 5) at risk is shown below the x-axis, and the total number of events in each risk group is shown in boxes beside the lines.

Table 6 shows the comparison of GPSM and GC categorization of subjects to risk groups. The study consists of mainly high-risk patients; as such there are no GPSM low risk patients. Here we show that GC can adequately identify those patients that are truly high-risk from those that are not, we confirm this using a McNemar's test. Considering this is a high-risk cohort of adverse pathology, most patients were GPSM high-risk (n=196) with a smaller number of GPSM intermediate-risk (n=23). GPSM and GC gave consistent results in 88 (40%) of subjects, but GC reclassified 124 out of 196 (63%) GPSM high-risk (GPSM>10) patients into lower risk groups. With additional genomic information, the GC systematically downgraded GPSM high-risk subjects to lower risk categories (p<0.0001 McNemar's test). Given, the low cumulative incidences of metastatic disease (FIG. 18), even patients with 'high-risk' adverse pathology or GPSM scores who have low GC scores, have a very low probability of mets.

Univariable analysis is detailed in Table 7 and shows that in this high-risk cohort, the majority of the clinicopathologic variables, with the exception of margin status and pre-operative PSA, were significant prognostic factors. GC has a high precision in estimating increasing risk of 56% of developing mets for every 0.1 unit increment in GC score (HR=1.56, CI: 1.35-1.80, p<0.001). However, with multivariable Cox regression modeling of the individual clinical and genomic components of the GCC model, while GC remained a significant variable with an HR of 1.48 (CI: 1.27-1.73, p<0.001) for every 0.1 unit increment in GC score, no clinical variables remained significant for predicting mets (Tables 8-9). In Table 8, GC is adjusted for clinicopathologic components of GCC (seminal vesicle invasion, pathological Gleason sum, pre-operative PSA, extra-capsular extension, lymph node involvement and positive margin as well as administration of adjuvant hormones. The Lin-Ying method was used to account for the case-cohort design when determining the hazard ratios. The GC hazard ratio is for a 0.1 unit change in the GC risk score.

GC was also adjusted for CC and GPSM in separate multivariable regression analyses and yet remained the only significant risk factor (Table 10).

TABLE 6

Reclassification of GPSM categories by GC.

| #patients (% mets by 5 years) | GC <0.5 | GC >=0.5 | GPSM Totals |
|---|---|---|---|
| GPSM Intermediate | 16(4%) | 7(4%) | 23(8%) |
| GPSM High | 124(29%) | 72(63%) | 196(92%) |
| GC Totals | 140(33%) | 79(67%) | |

TABLE 7

Univariable Analysis for panel of prognostic classifiers and clinicopathologic variables (for mets)

| | Hazard ratio (95% CI) | p-value |
|---|---|---|
| GC | 1.56 (1.35-1.80) | <0.001 |
| GCC | 1.40 (1.24-1.58) | <0.001 |
| CC | 1.31 (1.15-1.49) | <0.001 |
| Pathologic Gleason Sum | 2.45 (1.38-4.36) | =0.002 |
| GPSM | 1.32 (1.12-1.56) | <0.001 |
| Extra Capsular Extension | 2.68 (1.49-4.83) | =0.001 |
| Seminal Vesicle Invasion | 2.18 (1.22-3.87) | =0.007 |
| Lymph Node Invasion | 2.18 (1.04-4.56) | 0.04 |
| Pre-operative PSA | 1.21 (0.94-1.57) | 0.15 |
| Positive Margins | 0.96 (0.54-1.69) | 0.88 |

TABLE 8

Multivariable Cox regression analysis.

| | Hazard ratio (95% CI) | p-value |
|---|---|---|
| GC | 1.48 (1.27-1.75) | <0.001 |
| Gleason Sum | 1.83 (0.83-4.09) | 0.14 |
| Seminal Vesicle Invasion | 1.47 (0.70-3.08) | 0.30 |
| Extra Capsular Extension | 1.37 (0.63-3.01) | 0.43 |

TABLE 8-continued

Multivariable Cox regression analysis.

| | Hazard ratio (95% CI) | p-value |
|---|---|---|
| Pre-operative PSA | 1.13 (0.79-1.63) | 0.51 |
| Positive Margins | 1.10 (0.53-2.25) | 0.80 |
| Lymph Node Invasion | 0.94 (0.28-3.15) | 0.92 |

*adjusted for adjuvant hormone therapy

TABLE 9

Multivariable Analysis for panel of prognostic classifiers and clinicopathologic variables Adjusted for Hormone Therapy (for mets)

| | Hazard ratio (95% CI) | p-value |
|---|---|---|
| GC | 1.49 (1.27-1.75) | <0.001 |
| Seminal Vesicle Invasion | 1.75 (0.80-3.85) | 0.16 |
| Gleason Sum | 1.43 (0.70-2.90) | 0.33 |
| Extra Capsular Extension | 1.32 (0.61-2.86) | 0.49 |
| Pre-operative PSA | 1.15 (0.81-1.62) | 0.44 |
| Positive Margins | 1.09 (0.53-2.25) | 0.81 |
| Lymph Node Invasion | 0.85 (0.30-2.45) | 0.77 |
| Hormone Therapy* | 0.92 (0.44-1.93) | 0.84 |

*adjusted for salvage or adjuvant hormone therapy

TABLE 10

Multivariable Analysis of GC compared to GPSM and CC (for mets)

| | Hazard ratio (95% CI) | p-value |
|---|---|---|
| MVA with GC and GPSM | | |
| GC | 1.51 (1.31-1.75) | <0.001 |
| GPSM | 1.16 (0.96-1.39) | 0.17 |
| MVA with GC and CC | | |
| GC | 1.51 (1.29-1.75) | <0.001 |
| GPSM | 1.12 (0.96-1.30) | 0.16 |

DISCUSSION

This study describes the development and independent validation of a novel prognostic biomarker signature, a genomic classifier (GC) identified by analyzing 764 high-risk radical prostatectomy patients (545 in discovery set and 219 in an independent validation set) with long-term follow-up. The GC was designed to predict rapid metastatic disease progression, an endpoint based on radiographic imaging that is clinically much more relevant for aggressive prostate cancer than most previous biomarker reports using the BCR endpoint. All tumor specimens were profiled using high-density microarray analysis of RNA from archived patient FFPE specimens. The transcriptome-wide approach allowed interrogation of a much richer genomic dataset, including many thousands of ncRNAs, compared to previous efforts which were primarily protein-coding 'gene-centric'. The GC model was validated in an independent blinded study of a contemporary cohort (2000-2006) of prostatectomy patients with adverse pathology, reflecting the population where clinical variables and nomogram models fail to decipher the small percentage of men who will develop lethal prostate cancer.

In the high-risk validation cohort of 1,010 men treated at the Mayo Clinic, only 7.5% developed metastatic disease.

Even after accounting for use of adjuvant therapy, risk stratification based on pathology alone failed to accurately predict metastatic disease and supporting the notion that even high risk prostate cancer is a molecularly heterogeneous disease. The improved calibration of genomic models over clinical-only models may be due to incorporation of true molecular drivers of aggressive disease in the GC models, so that even in a clinicopathologic homogeneous 'high-risk' patient population, GC can better segregate 'true high-risk' patients from the majority who will not progress. Decision curve analysis also showed that the prognostic classifiers using genomic information had a broader range of clinical benefit, based on "decision-to-treat" thresholds, compared to clinical-only models. Again, the limited range of benefit shown by the CC and GPSM models may be a further reflection of their limited discriminative ability in high risk men. Lastly, even after adjusting for adjuvant therapy multivariable analysis showed GC remained the only significant predictor, suggesting that the genomic signature captures most of the prognostic information as it relates to metastatic disease development in the high-risk cohort.

To our knowledge, this is the first study to extensively validate a biomarker signature based primarily on ncRNA. This may be an important reason why the GC model (only 3 features selected from protein-encoding mRNA; see Table 4) showed significantly improved performance over previous gene-based models. Supporting this notion, we recently reported our reanalysis of the MSKCC Prostate Oncogenome Project expression data and demonstrated that ncRNA expression was more prognostic than protein-coding genes and in multivariable analysis provided predictive information independent of the Kattan nomogram. The importance of ncRNA in aggressive prostate cancer is further highlighted by several recent studies that have demonstrated their involvement in tumor cell invasion and metastasis.

The vast majority of patients with aggressive disease have adverse pathology. However, the fact remains that most patients with adverse pathology will not die from prostate cancer. The question remains for most urologists and their patients, of when, and how, to intervene for patients with adverse pathology. Up to 20% of RP patients with adverse pathology in contemporary practice will inevitably require additional intervention with radiation, hormones or chemotherapy as durable cancer control will not be achieved using radical surgery alone. Three large, randomized clinical trials (SWOG 8794, EORTC 22911 and ARO 96-02) have shown improved biochemical recurrence-free and/or metastasis-free survival for men with adverse pathology when treated with immediate adjuvant radiation therapy versus initial observation. Initial reports from the RTOG 96-01 trial, which randomized early salvage radiation patients to anti-androgen therapy or observation, indicated that intensification with multimodal therapy post RP reduces the incidence of metastatic disease. Despite this evidence, urologists have not widely adopted adjuvant intervention after RP and favor instead treatment upon PSA relapse or biochemical recurrence (BCR).

This practice, however, may lead to under-treatment of some patients in the adjuvant setting, where radiation has a proven benefit and over-treatment of many patients in the salvage setting, since BCR is a poor surrogate for metastatic disease.

As management strategies evolve, a 'reverse stage-shift' has occurred in the last decade, whereby more low-risk patients opt for active surveillance and more high-risk patients undergo RP. As a result, urologists are seeing a higher proportion of patients with adverse pathology after RP. In a contemporary cohort of men with adverse pathology we show that adding genomic variables to established clinical risk factors significantly improves prediction models for metastatic disease. Furthermore, we found that most of the prognostic information for predicting metastatic disease is captured by the genomic variables, which are measured in the primary tumor. This data supports the notion that genomic alterations in lethal prostate cancer manifest early on, many years before metastatic disease can be radiographically imaged. Improved identification of patients most at risk for developing disease may better serve those most in need for adjuvant therapy. It is in these patients that we are further testing the performance of this classifier, its usefulness in guiding risk stratification and decision-making after RP in additional validation studies. More accurate prediction of lethal prostate cancer within this high risk population of surgical prostate cancer patients may lead ultimately to improved outcomes.

Gleason 7 Sub Cohort Analysis

Figure 19A:
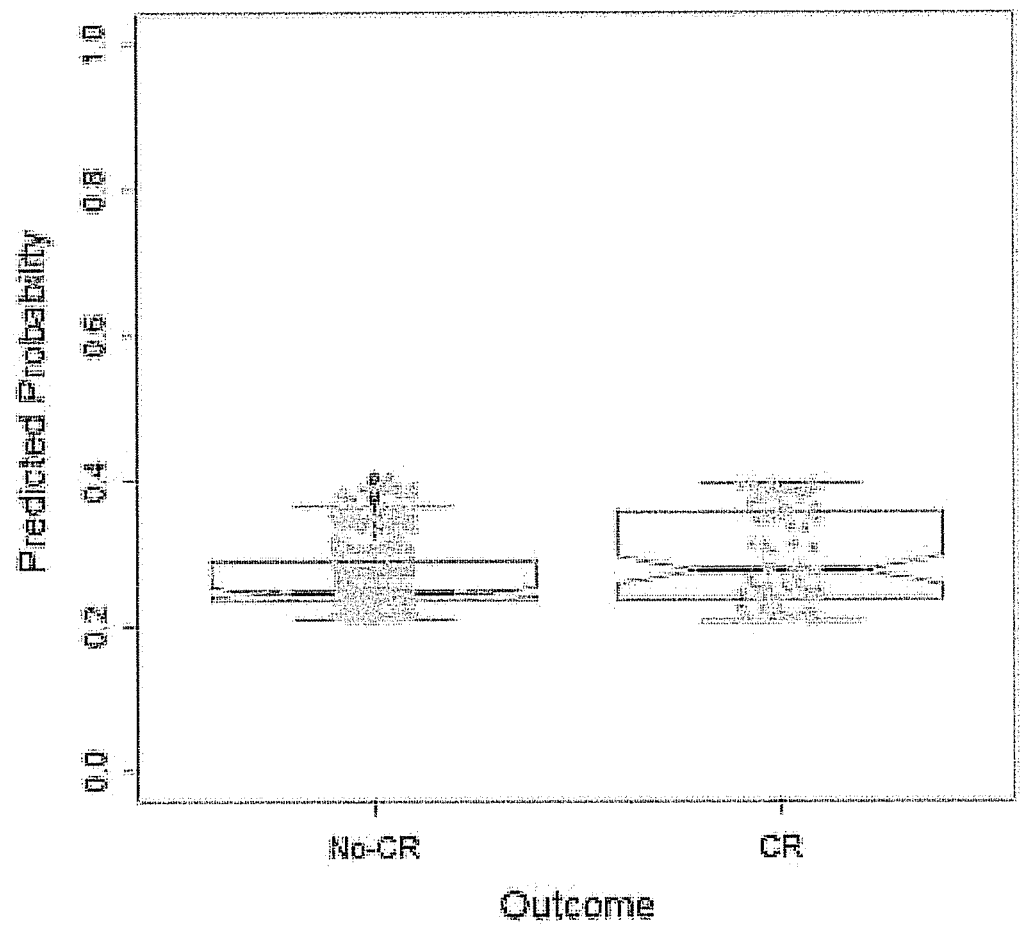
FIGS. 19A-B. Discrimination plots showing segregation of Gleason 7 patients by CC (or CM, for Clinical Model) and GCC (n=382)
Figure 19B:
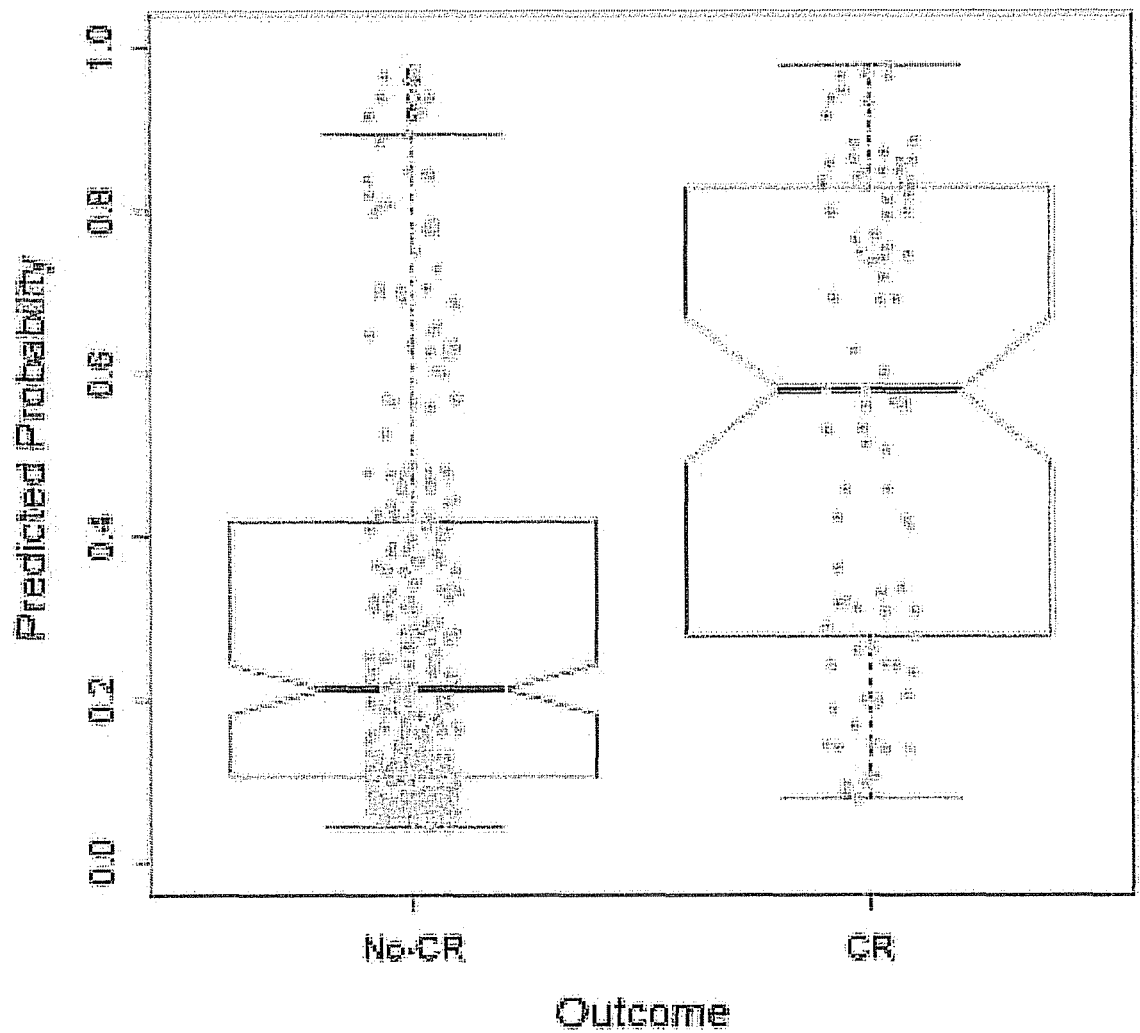
Figure 20A:
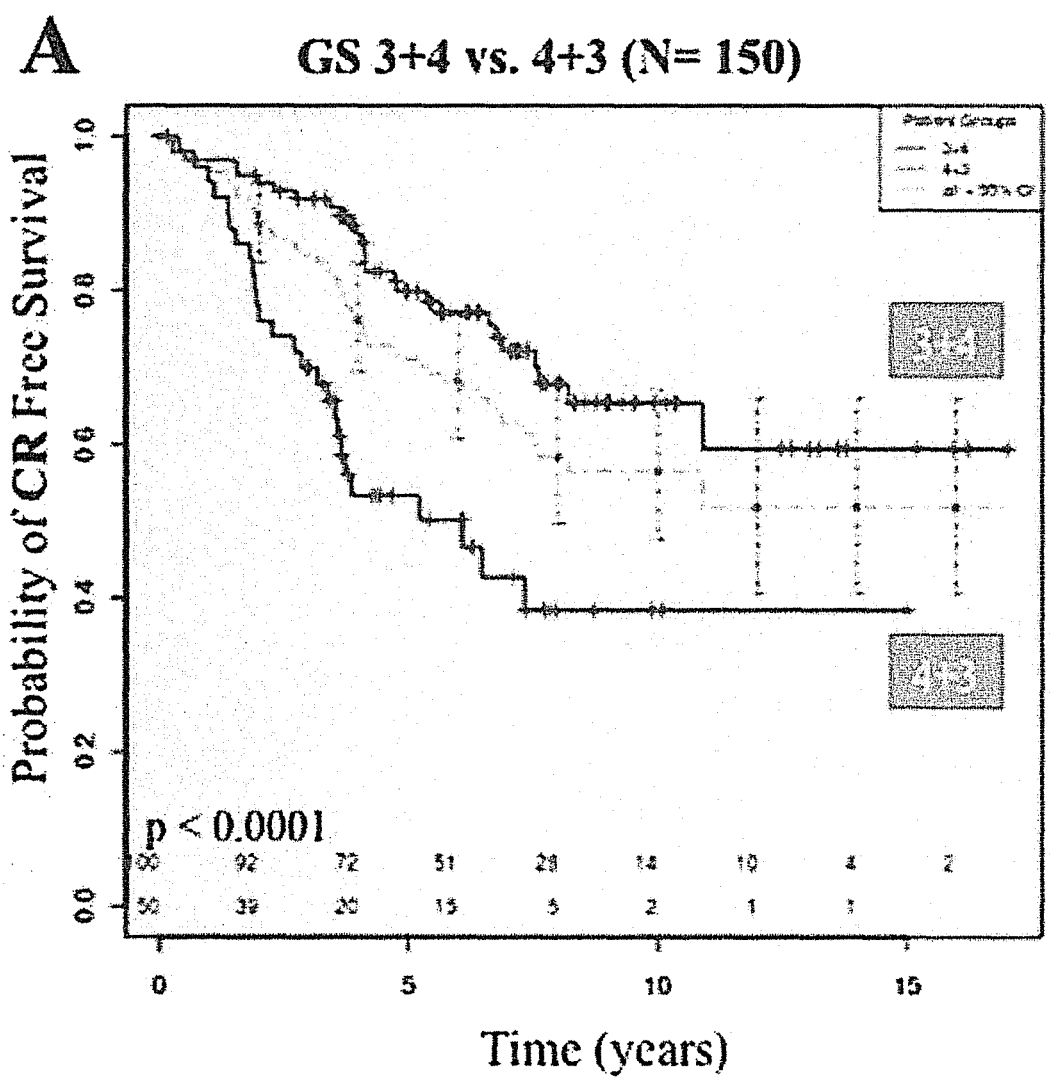
FIGS. 20A-B. CM and GCC Risk Groups of Gleason 7, 4+3 and 3+4 patients with CR endpoint (n=150)
Figure 20B:
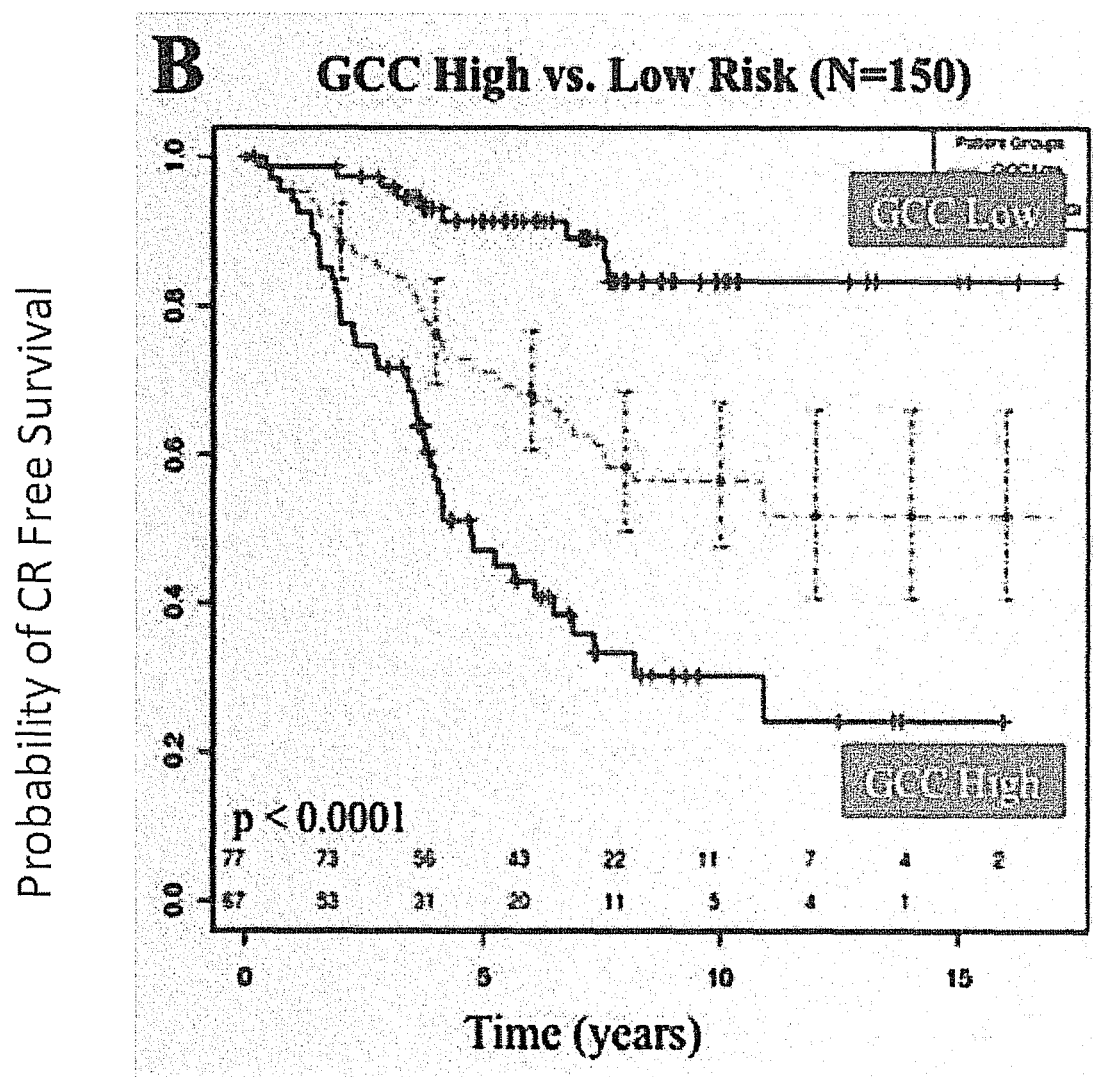
Figure 21A:
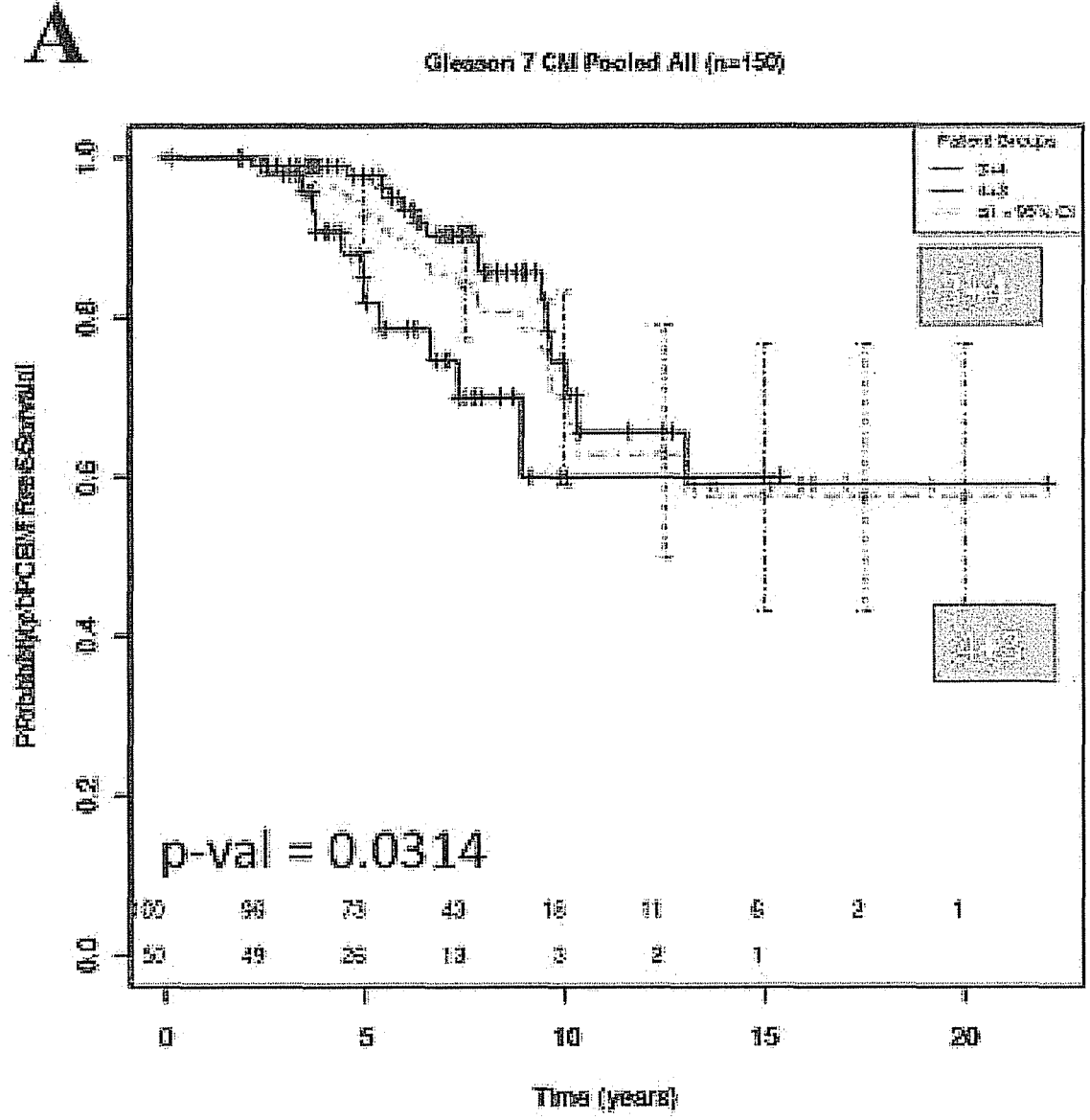
FIGS. 21A-B. GCC stratification of Gleason 7, 4+3 and 3+4 patients with PCSM endpoint (n=150)
Figure 21B:
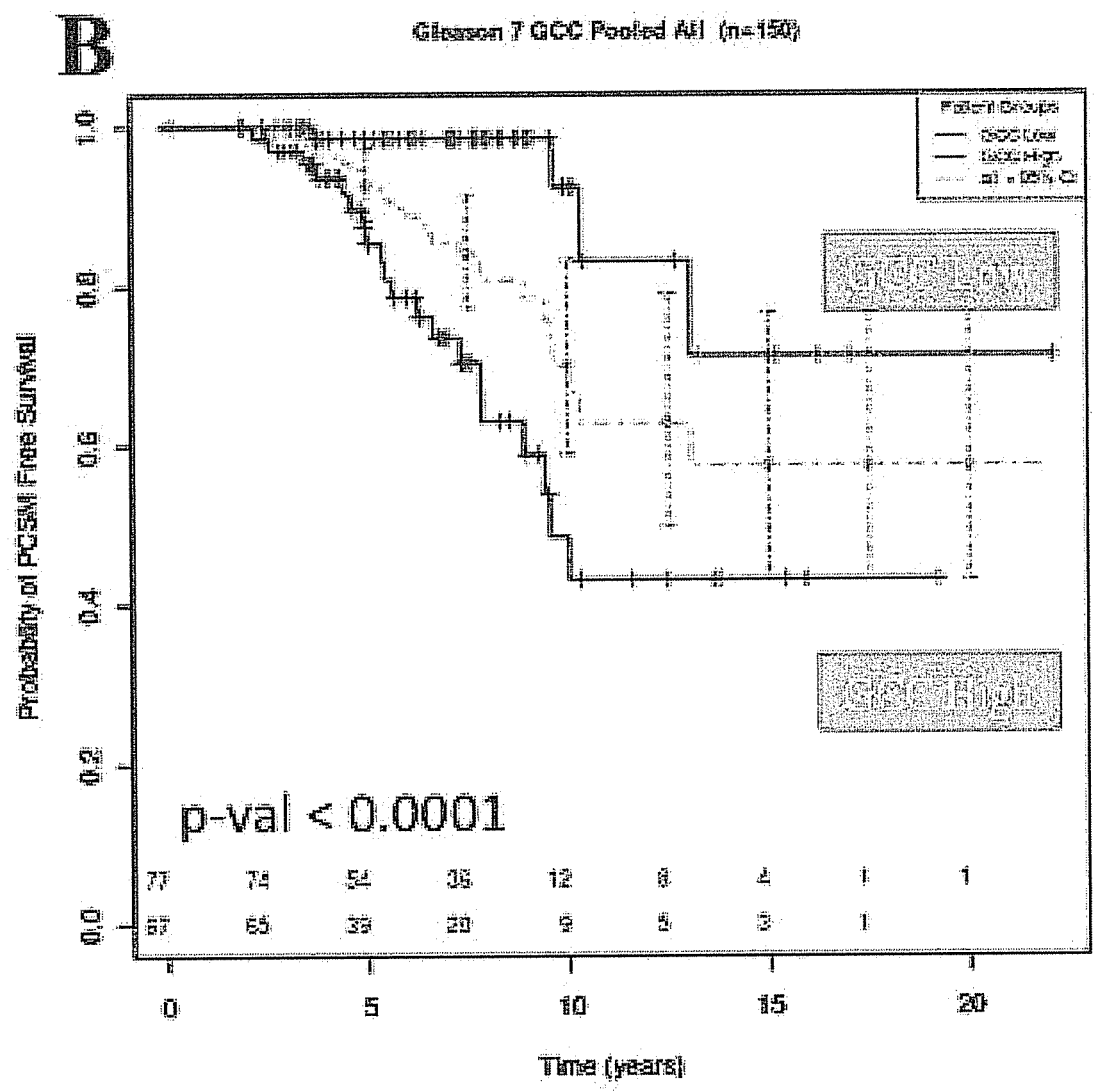
Figure 22A:
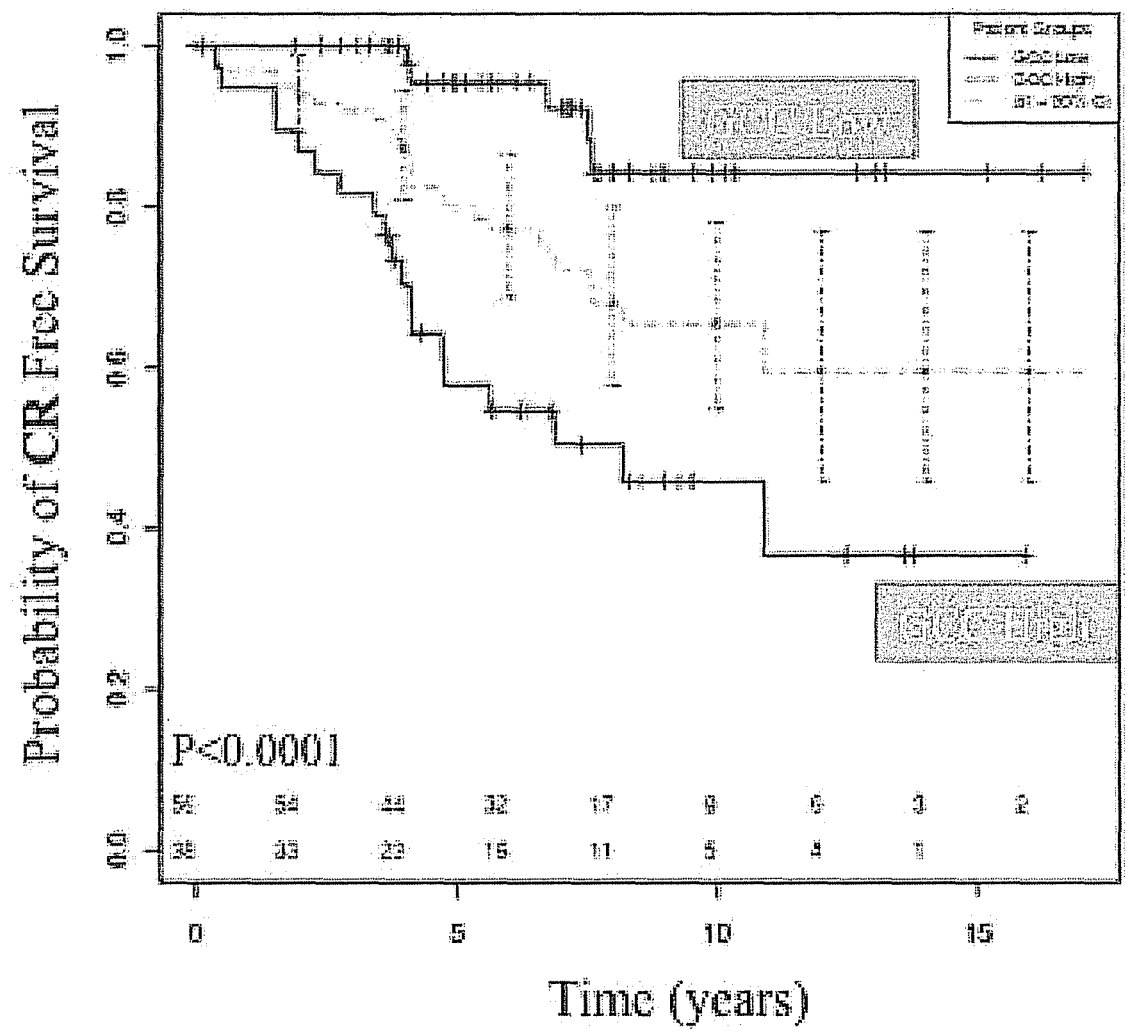
FIGS. 22A-B. Gleason 4+3 (n=50) and 3+4 (n=100) sub-stratification by GCC with METS (or CR, for Clinical Recurrence) endpoint FIGS. 23A-B. Gleason 4+3 (n=50) and 3+4 (n=100) sub-stratification by GCC with PCSM endpoint FIGS. 24A-B. Stratification of uniformly treated N+ patient by GCC and CC (or CM, for Clinical Model) (n=97 and n=96) with METS (or CR, for Clinical Recurrence) endpoint FIGS. 25A-B. Stratification of uniformly treated N+ patient by GCC and CC (or CM, for Clinical Model) (n=97 and n=96) with PCSM endpoint FIG. 26. Multidimensional scaling plot of (A) the training and (B) the testing sets. Controls are indicated as '+' and cases are indicated as circles. In both the training and validation sets the controls tend to cluster on the left of the plot and the cases on the right of the plot. In this manner, most of the biological differences are expressed in the first dimension of the scaling. Random forest proximity [http://www.stat.berkeley.edu/~breiman/] was used to measure the 22 marker distance between samples.
Figure 22B:
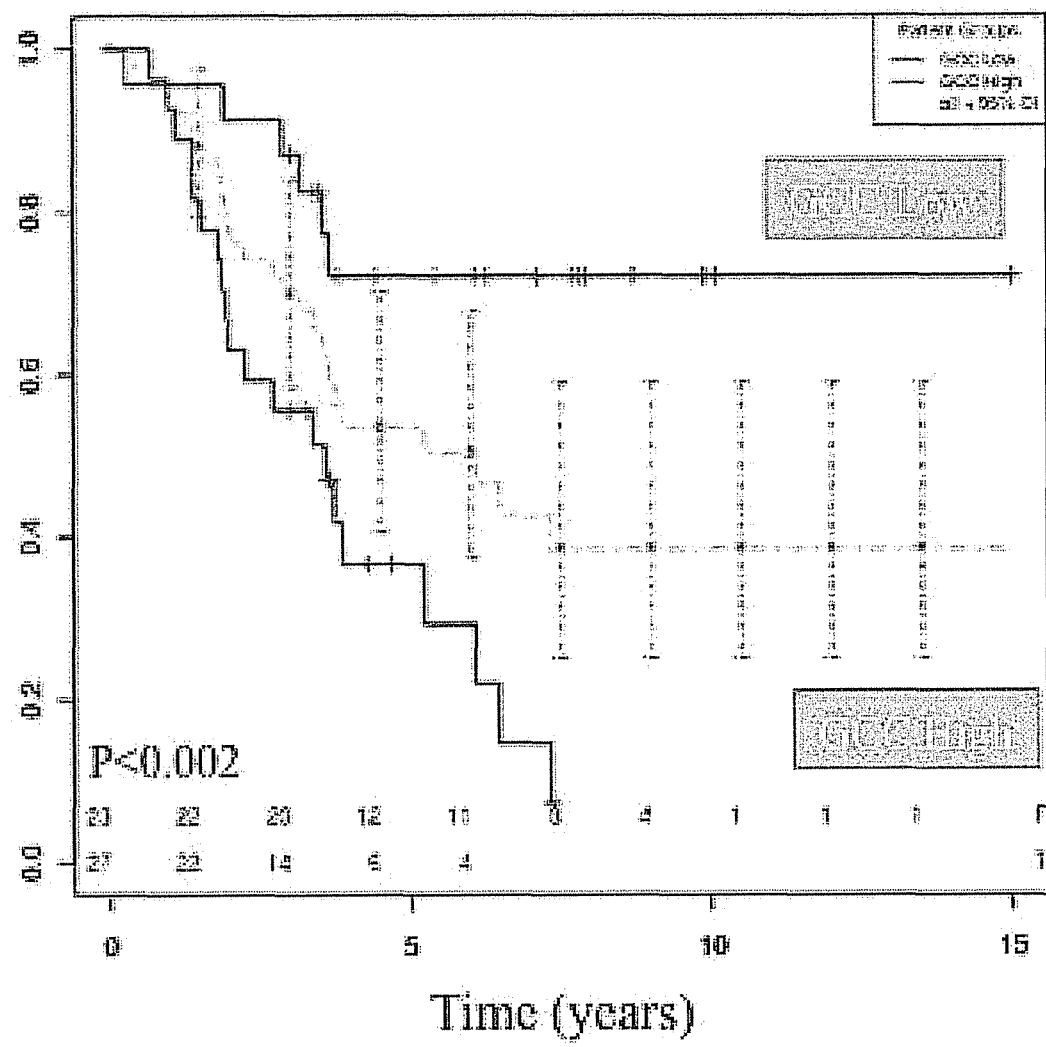
Figure 23A:
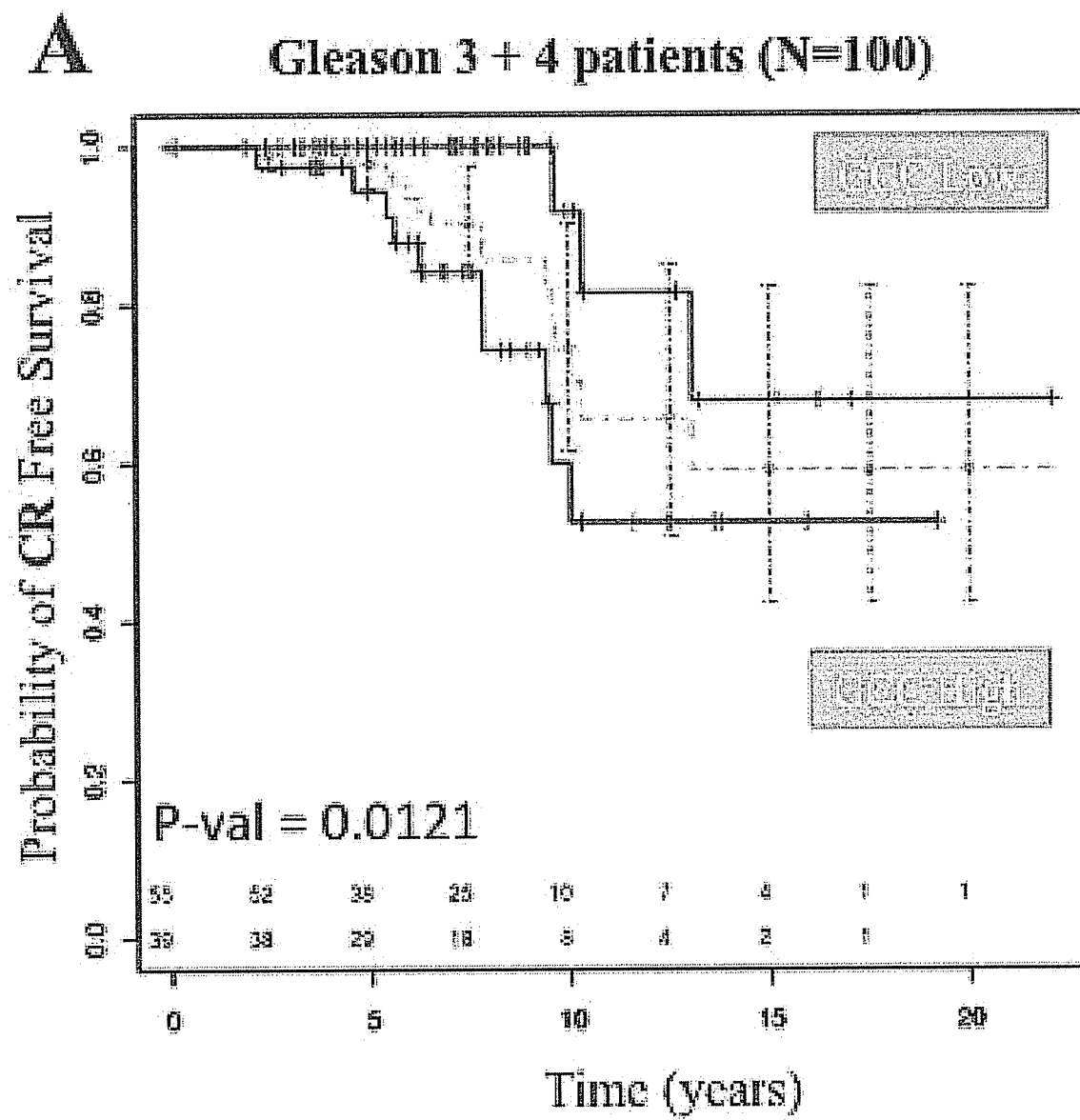
Figure 23B:
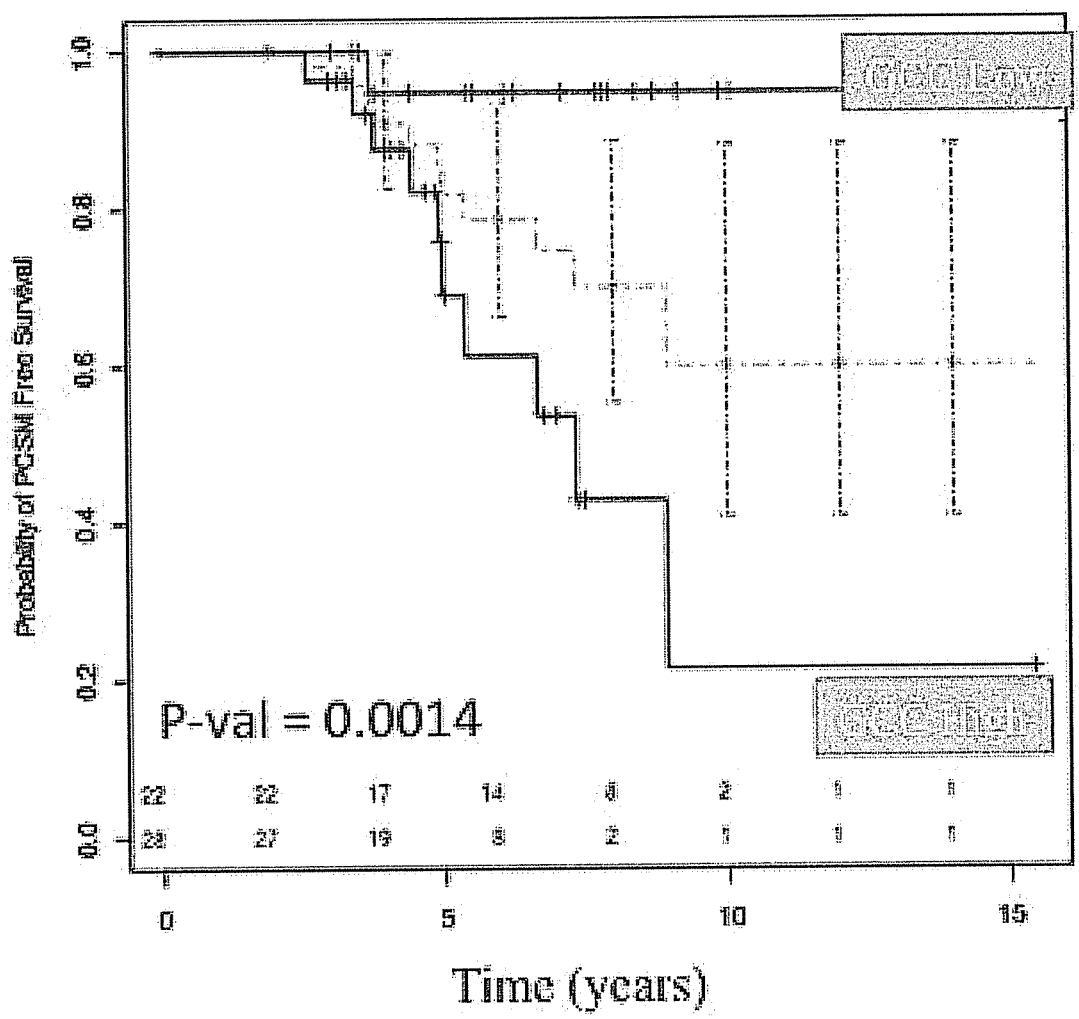

Patients with pathological Gleason stage 7 represent a difficult to classify intermediate category in prostate-cancer clinical decision making. It has been suggested that patients with a primary Gleason 4 and secondary Gleason 3 (4+3) have a worse outcome than 3+4 patients. We demonstrated that GCC was better able to segregate Gleason 7 patients with improved outcome compared to the current 4+3 vs. 3+4 method. First, we compared the capacity of the CC (also referred to as the Clinical Model, or CM) and GCC to segregate Gleason 7 patients (FIG. 19), the discrimination plots in this analysis showed that CC does not segregate these patients at all. Departing from CC model, we compared the survival outcome for the Gleason 7 patients based on the aforementioned clinical practice and GCC. FIG. 20 clearly shows the superiority of the GCC in segregating these patients with a mets endpoint (also referred to as Clinical Recurrence, or CR). Importantly, the GCC is also able to segregate patients when the endpoint was changed to PCSM; the conventional 4+3 vs. 3+4 methods has a limited capacity to separate patients as shown in FIG. 21. We further separate samples into their respective 4+3 and 3+4 categories and assessed the performance of the GCC within these groups and found that for both mets and PCSM end points the GCC was capable of significantly segregating patients into high (GCC>=0.5) and low risk (GCC<0.5) groups (FIGS. 22-23).

Application to Adjuvant Hormones Lymph Node Positive Patients

Figure 24:
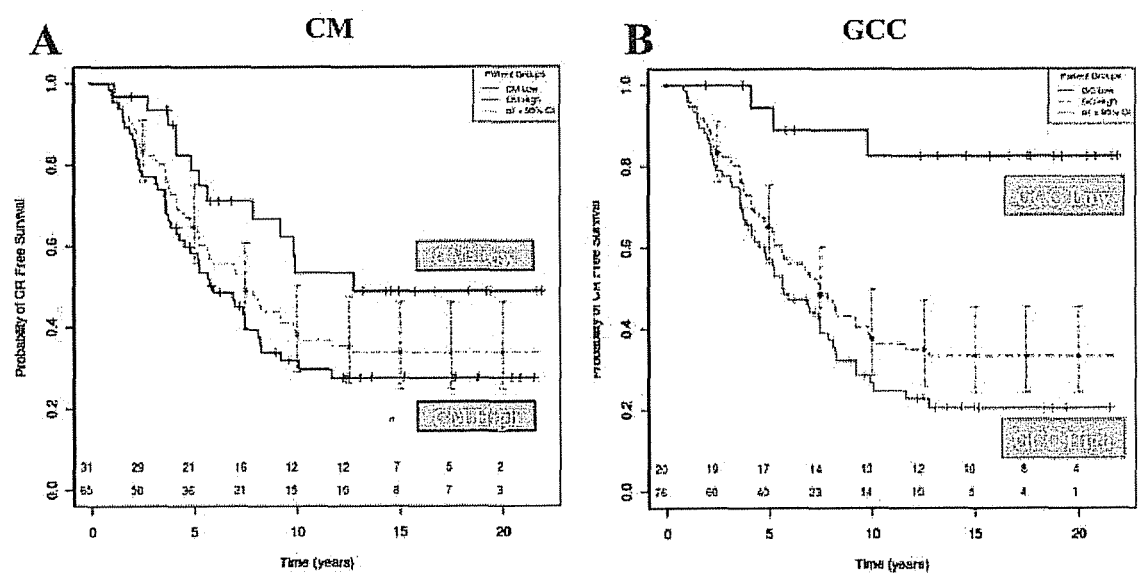
Figure 25A:
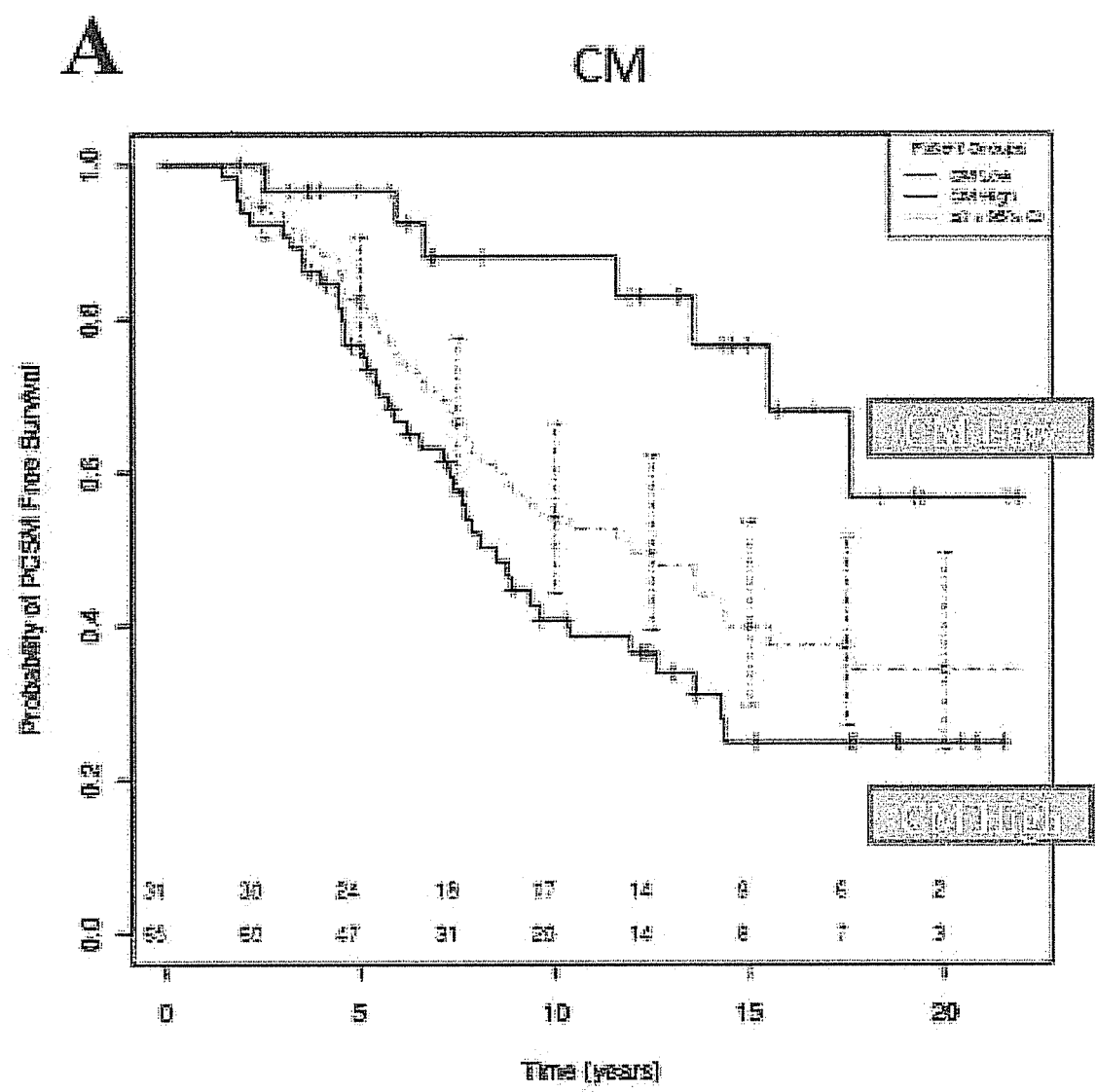
Figure 25B:
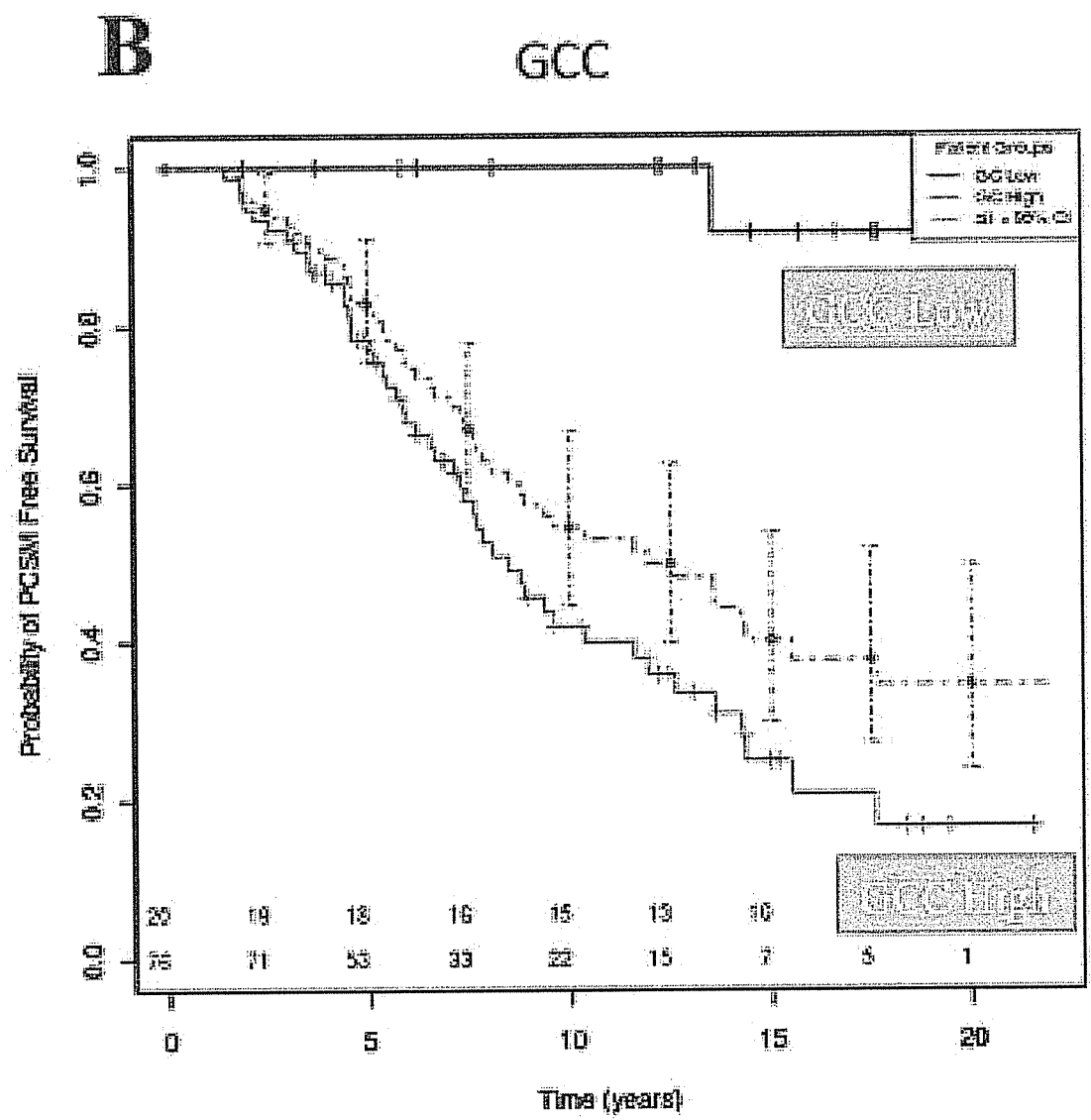

We assessed the capacity of GCC to segregate a set of Lymph Node positive (N+) patients uniformly treated with adjuvant hormone therapy. We compared its performance against CC and used both the mets and PCSM endpoint (FIGS. 24-25). Since GCC and CC contain LNI status as a variable in model training and prediction, the LNI status might augment the results when the analysis is focused solely on N+ patients. Overall however either model is intended to be applied to broad range of patients with varying pathological characteristics and so it is practical to consider CC and GCC with LNI status even when focusing on the N+ group. Furthermore, N+ patients are uniformly treated in clinical settings with Adjuvant Hormones (ADTHx+) as standard of care; the ability of the GCC to further segregate the N+ patients into good and poor outcomes even after ADT might indicate an important clinical utility that could warrant the treatment of high risk (GCC>0.5) patients with additional therapies. Currently, there are no existing clinical instruments that further differentiate N+ patients.

Example 4: Method of Diagnosing a Leukemia in a Subject

A subject arrives at a doctor's office and complains of symptoms including bone and joint pain, easy bruising, and fatigue. The doctor examines the subject and also notices that the subject's lymph nodes are also swollen. Bone marrow and blood samples are obtained from the subject. Microarray analysis of the samples obtained from the subject reveal aberrant expression of one or more transcripts selected from Tables 2, 4, 11 or 55 and the subject is diagnosed with acute lymphoblastic leukemia.

Example 5: Method of Determining a Treatment for Breast Cancer in a Subject

A subject is diagnosed with breast cancer. A tissue sample is obtained from the subject. Nucleic acids are isolated from the tissue sample and a probe set comprising at least ten probes capable of detecting the expression of at least one non-coding RNA transcript and at least one protein-coding transcript. Analysis of the expression level of one or more transcripts selected from Tables 2, 4, 11 or 55 reveals the subject has a tamoxifen-resistant breast cancer and gefitinib is recommended as an alternative therapy.

Example 6: Method of Determining the Prognosis a Pancreatic Cancer in a Subject

A subject is diagnosed with pancreatic cancer. A tissue sample is obtained from the subject. The tissue sample is assayed for the expression level of biomarkers comprising one or more transcripts selected from Tables 2, 4, 11 or 55. Based on the expression level of the one or more transcripts selected from Tables 2, 4, 11 or 55, it is determined that the pancreatic cancer has a high risk of recurrence.

Figure 26:
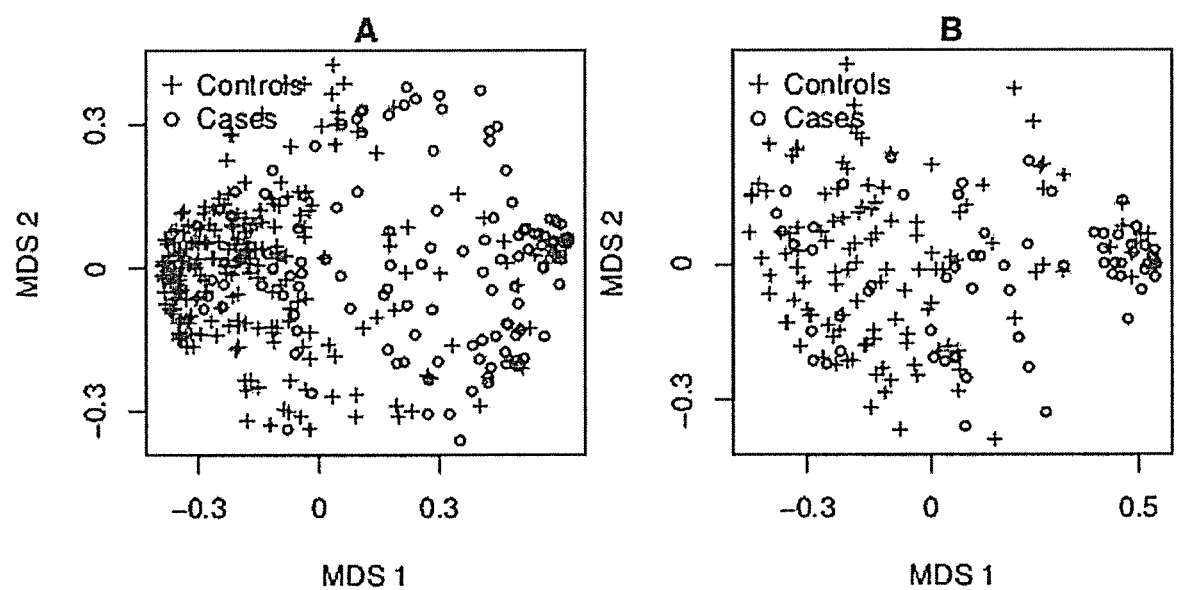

Example 7: A 22-Marker Genomic Classifier (GC) Outperformed Previously Reported Genomic Signatures and Individual Gene Biomarkers As described in Example 3, a final set of 22 markers was selected for building a random forest classifier. The high-density array used in this study permits measurement of the expression patterns of RNAs associated with multiple biological processes in prostate cancer progression. Also, this transcriptome-wide approach allowed interrogation of a much richer genomic dataset, including thousands of ncRNA. Furthermore, the genomic markers measure the biological potential of the tumor to metastasize. The biological processes represented in the 22 markers include cell cycle progression, cell adhesion, tumor cell motility, migration and immune system modulation Multidimensional scaling analysis depicts clustering of cases and controls based on the expression of these 22 markers (FIG. 26). Controls correspond to pooled NED and PSA patients since, at a fold-change threshold of 1.5 (after correcting for false-discovery), only 2 (out of ~1.4 million) features were found to be differentially expressed between these two groups groups, compared to 1187 and 887 in metastasis outcomes compared to NED and PSA groups. A random forest machine-learning algorithm was used to generate GC scores on the training and testing set after assembling the 22 markers with forest parameters to optimize for highest accuracy in the training set. The performance of GC was compared to that of previously published gene signatures: Agell et al 2012, Bibikova et al 2007, Bismar et al 2006, Cuzick et al 2011, Glinsky et al 2005, LaPointe et al 2004, Larkin et al 2012, Nakagawa et al 2008, Olmos et al 2012, Penney et al 2011, Ramaswamy et al 2003, Ross et al 2012, Talantov et al 2010, Varambally et al 2005 and Yu et al 2007 and individual genomic markers associated with prostate cancer progression including CHGA, DAB2IP, GOLPH2, PAP, ETV1 and ERG, KI-67, PSA, PSCA, PSMA, AMACR, GSTP1, PCA3, B7-H3, TOP2A and CAV1. Each genomic marker and gene in the signatures were mapped to its associated Affymetrix core transcript Cluster (www.affymetrix.com/analysis/index.aff) where available, otherwise the extended transcript cluster was used. Based on the fRMA summarized expression values for the individual genes, the signatures were modeled in the training set using a random forest and tuned with the tune.randomForest function from the e1071 R package. Tuning involved performing a 20 by 20 grid search to find the optimal "mtry" and "nodesize" model parameters evaluated via 5-fold cross validation in order to maximize accuracy.

Figure 27:
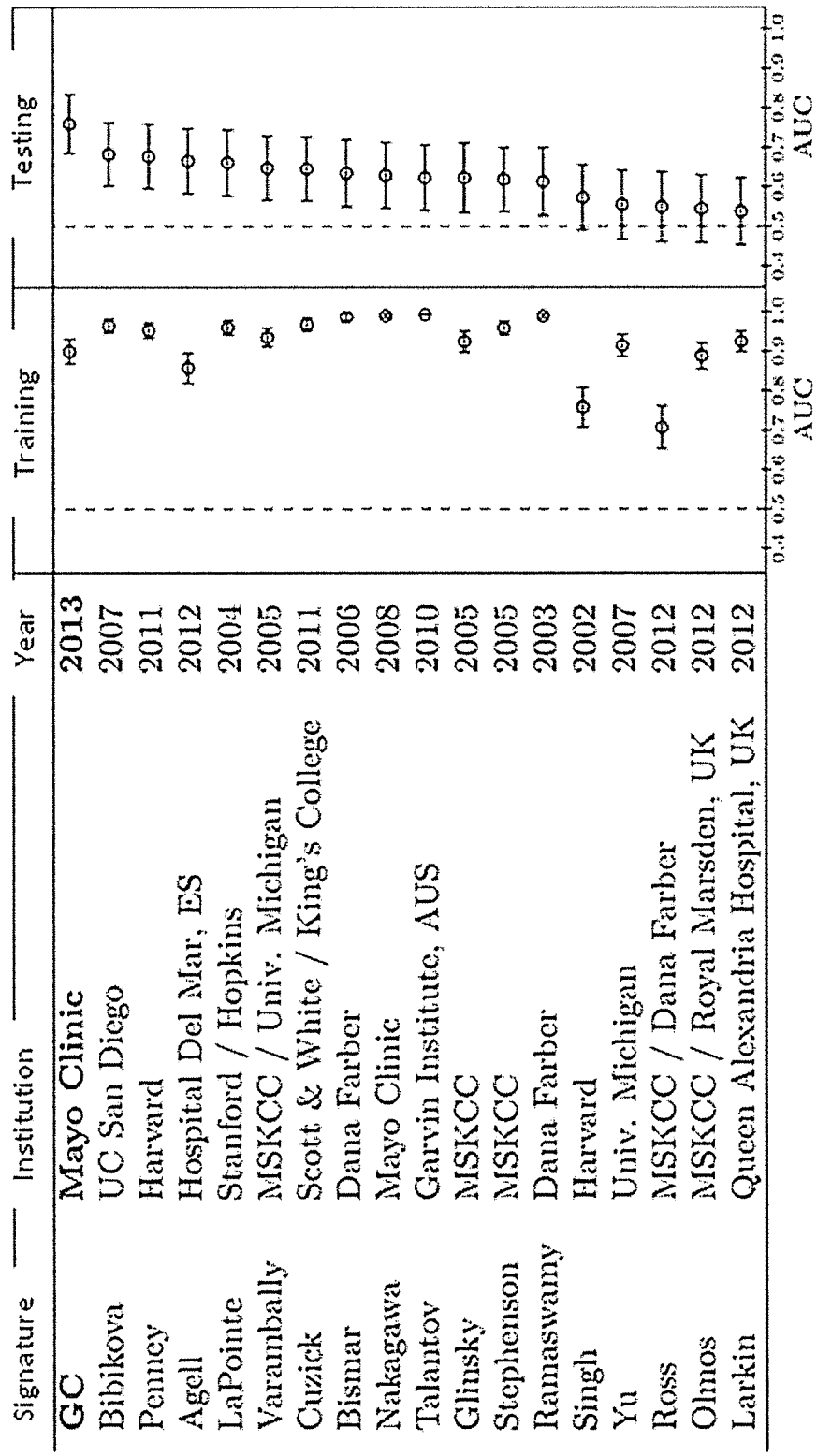
FIG. 27. Performance of external signatures in training and testing sets. For each signature, the institution associated to it, year of publication, lead author, the AUC obtained in the training and testing sets, as well as the 95% Confidence Interval for this metric is shown.
Figure 28:
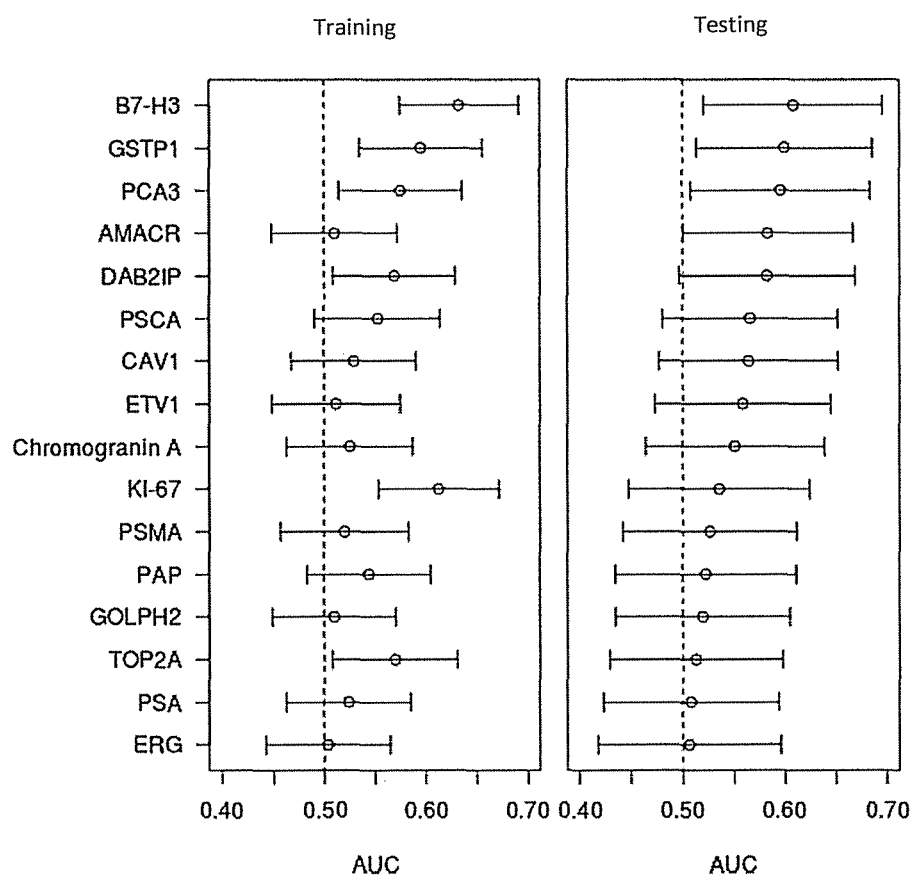
FIG. 28. Performance of single genes in training and testing sets. For each gene, the AUC obtained in the training and testing sets, as well as the 95% Confidence Interval for this metric is shown.

The performance of the classifiers and the individual genes was subsequently assessed in both training and testing sets (FIG. 27 and FIG. 28). As expected, we observed high AUCs in training for nearly all the external signatures, similar to what was observed with GC. When applied to testing, the AUC for each model decreased. Among the 17 external signatures that were modeled, 12 were statistically significant predictors of metastasis (e.g., their 95% confidence intervals did not drop below a threshold random chance AUC of 0.5) (FIG. 27). The AUC of GC was 0.08 points higher than the top performing external signature, the 16-gene signature reported by Bibikova et al, which had an AUC of 0.68 (95% CI: 0.60-0.76). In contrast to the expression signature models, the performance of the 16 single genes tested were expected to be similar in the training and testing sets. These genomic markers showed an overall agreement in performance, with differences in significance possibly explained by the smaller sample size of the testing set compared to the training set (FIG. 28). Of the 16 genomic markers, only B7-H3 (CD276), GSTP1 and PCA3 were statistically significant in both the training and testing sets (FIG. 28). Again, none of the individual genomic markers outperformed GC or the top performing clinical predictor, GS (AUCs≤0.64).

Example 8: A 22-Marker Genomic Classifier (GC) Outperformed Individual Clinicopathologic Variables and was Prognostic within Different Gleason Scores Groups Clinical variables were calculated, categorized or transformed as follows. Pathological Gleason Score (GS, or pathGS) was dichotomized into groups with the threshold of ≥8; although convention is to segregate GS into three groups (<6, 7, ≥8) the relative lack of patients with GS≤6 prompted the dichotomization of GS. The pre-operative PSA (pPSA), measured immediately prior to RP, was loge-transformed. The following variables were binary: Extra-capsular Extension (ECE); Seminal Vesicle Invasion (SVI); Surgical Margins (SM+, or SMS) and Lymph Node Involvement (N+, or LNI). Hormone and radiation therapy were included as separate binary covariates if administered in an adjuvant (<90 days post RP) or salvage (following PSA rise) setting. Treatments administered subsequent to clinical metastasis were not included.

Figure 29:
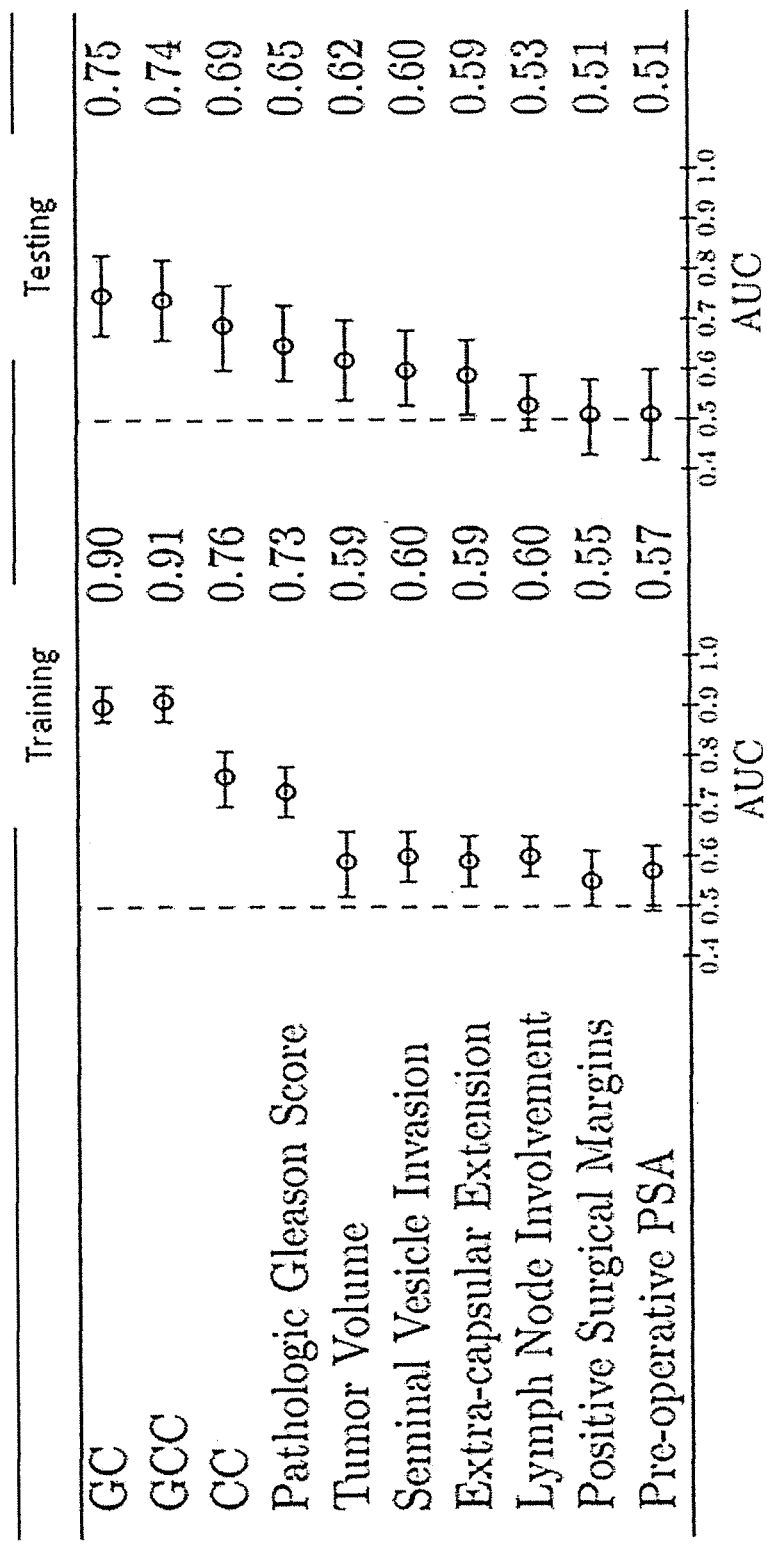
FIG. 29. ROC curve and AUC with 95% confidence interval for classifiers and individual clinicopathologic variables in training and testing sets. CC: clinical-only classifier. GC: genomic classifier. GCC: combined genomic-clinical classifier.
Figure 30A:
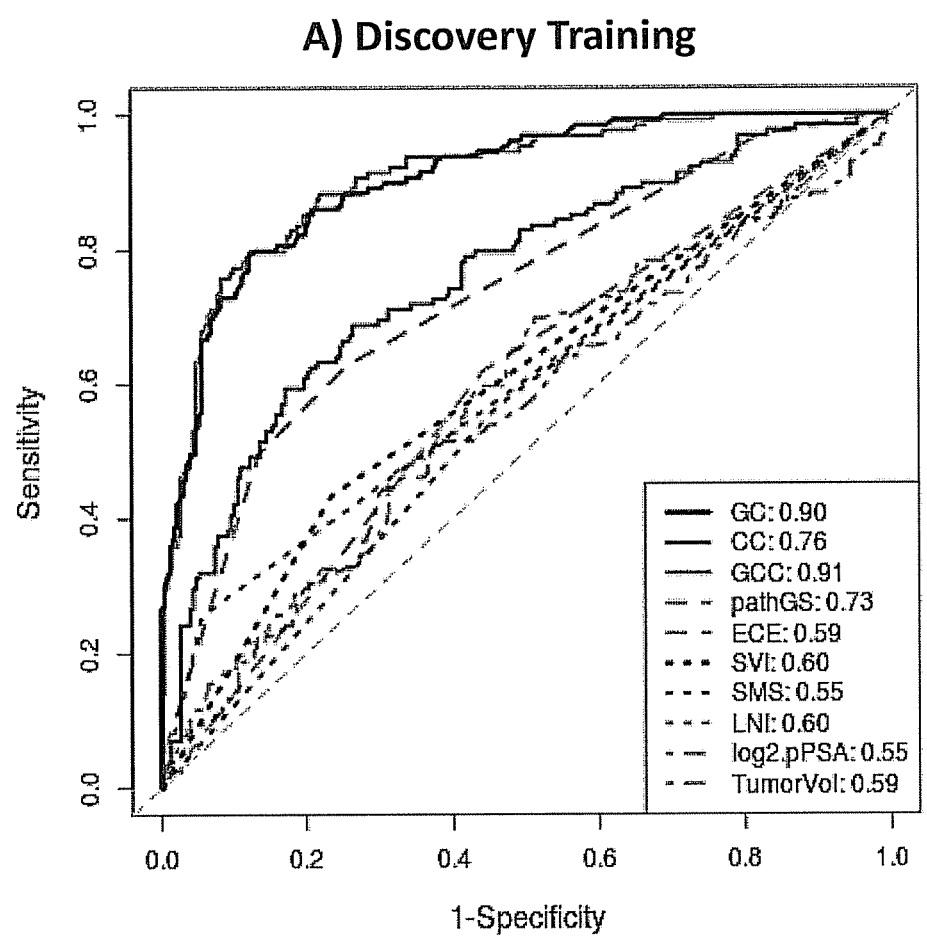
FIGS. 30A-B. ROC curve of multivariable models and individual clinicopathologic variables. A) ROC curves in Training B) ROC curves in testing.
Figure 30B:
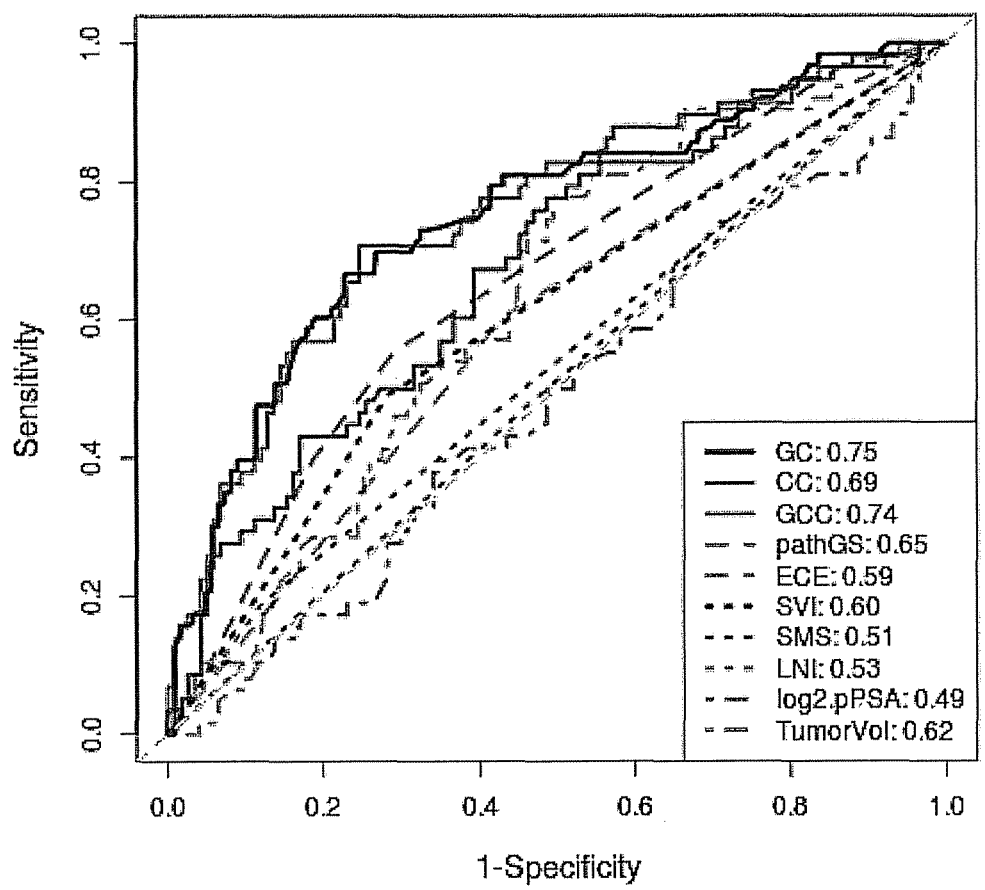

In the training set (see Example 1), ROC area-under the curve (AUC) values for GC, CC and GCC were 0.90, 0.76 and 0.91 respectively, outperforming all individual clinical variables: GSm N+, ECE, SVI, SM+, N+, pPSA and Tumor Volume (FIG. 29). In the testing set, GC and GCC had the highest AUC of 0.75, and 0.74, respectively for predicting cases. The clinical-only CC had an AUC of 0.69, which was only marginally better than pathological Gleason score alone (0.65). The shape of the ROC curves for GC and GCC showed that these models had the highest specificity and sensitivity compared to clinical models above a threshold of ~50% specificity (FIG. 30).

Figure 31:
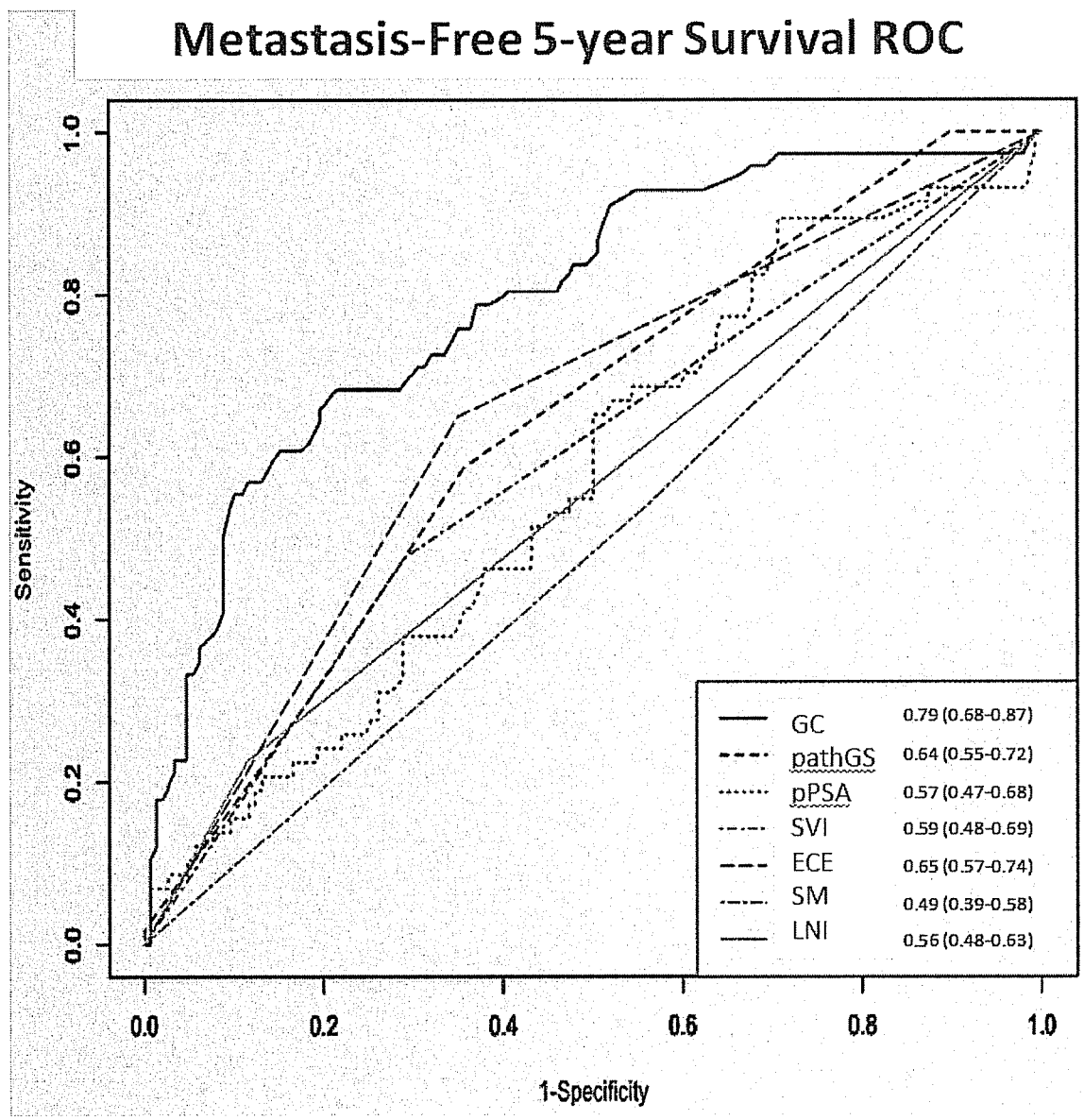
FIG. 31. Metastasis-Free 5-year Survival ROC of GC an individual clinicopathologic variables in the independent validation set.
Figure 32:
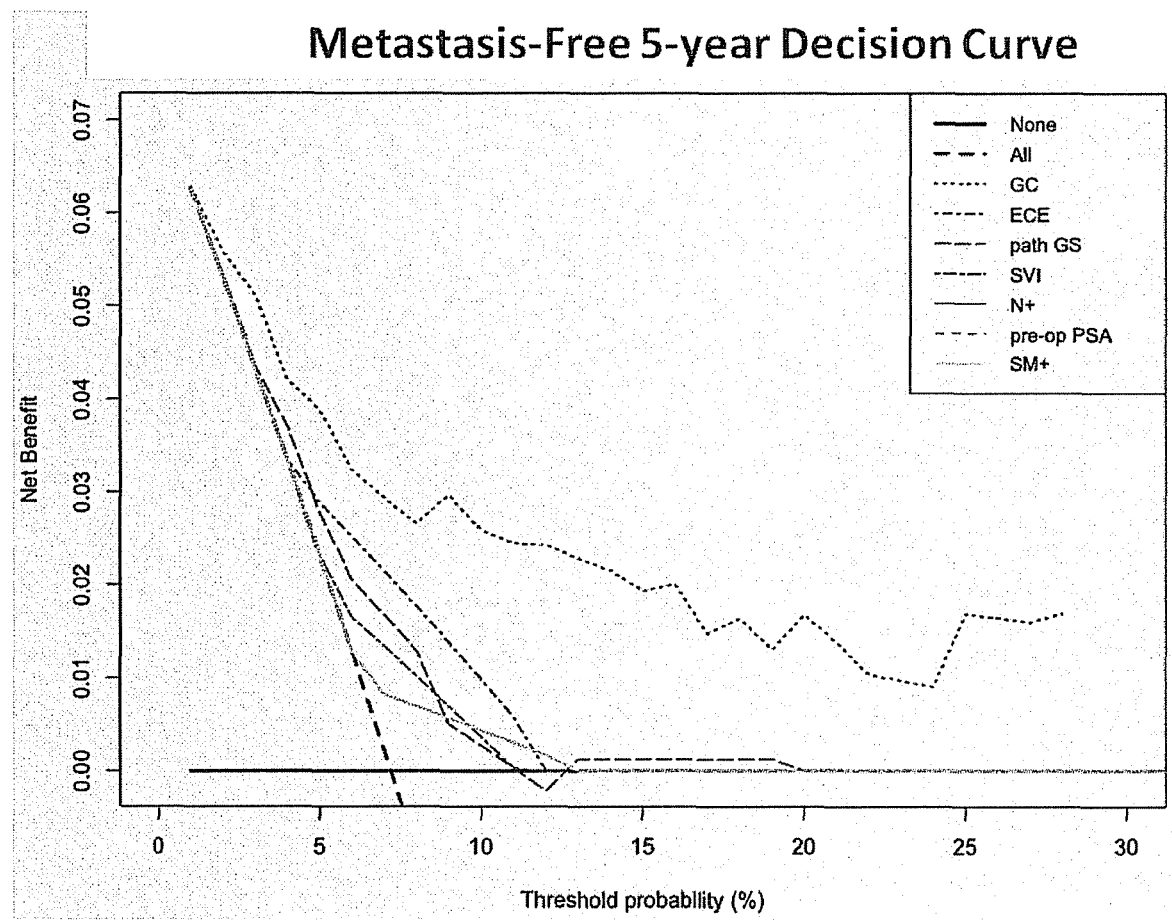
FIG. 32. Metastasis-Free 5-year Decision Curve of GC an individual clinicopathologic variables in the independent validation set.

A blinded study independently validated GC for prediction of clinical metastasis (metastasis) following radical prostatectomy. The results showed that the GC model had improved performance over any individual clinicopathologic variable or multivariable prediction model. In this independent validation set, the AUC of 5-year survival ROC curves demonstrated that GC had higher discriminatory ability than individual clinicopathologic variables (FIG. 31). The GC model had an AUC of 0.79 for predicting clinical metastasis at 5 years post RP with median follow up of 6.7 years. Furthermore, 5-year survival decision curve analysis on the independent validation set showed that GC had a higher net benefit over a wider range of 'decision-to-treat' probabilities than clinicopathologic factors (FIG. 32).

In order to test for the effect size of individual variables as well as dependencies among these variables, we performed univariable and multivariable analyses using logistic regression on the testing set (Table 12). In univariable analysis, we found GC, CC, GCC, GS, SVI and ECE to be statistically significant predictors of cases (p<0.05). The odds ratio for GC was 1.42 for every 10% increase in GC score. When dichotomized into low and high GC risk groups, as described above, the odds ratio was 6.79 (95% CI: 3.46-13.29), more than twice the odds ratio of Gleason score (OR: 3.02 (95% CI: 1.61-5.68)) for predicting cases. In multivariable analysis, after adjustment for post RP treatment, GC remained the only significant prognostic variable (p<0.001) with an OR of 1.36 for every 10% increase in GC score. The independent significance of GC suggested that a more direct measure of tumor biology (e.g., 22-marker expression signature) added significant prognostic information for prediction of early metastasis after rising PSA, which was not captured by the clinical variables available from pathological analysis.

In univariable analysis (UVA) on the independent validation set, GC had the highest significant hazard ratio (HR) among classifiers (Table 7). In multivariable analysis (MVA) on the independent validation set, only GC retained a significant HR when adjusted for clinical variables and postoperative adjuvant therapy (Table 8; P<0.001). Gleason score was alternatively parameterized (e.g., 3+4, 4+3, 8, 9-10) but this did not change the significance of GC (Table 13). Three additional MVA models were performed to model GC with CC, GPSM and the Stephenson nomogram. Only the Stephenson nomogram retained a significant HR (p<0.04) with GC as the dominant variable in the model (Table 10, Table 14).

TABLE 12

|  | Univariable | | Multivariable | |
| --- | --- | --- | --- | --- |
|  | Odds Ratio (95% CI) | P | Odds Ratio (95% CI) | P |
| GC | 1.42 (1.28-1.60) | p < 0.001 | 1.36 (1.16-1.60) | p < 0.001 |
| GCC | 1.36 (1.21-1.53) | p < 0.001 | n.a | n.a |
| CC | 1.35 (1.15-1.59) | p < 0.001 | n.a | n.a |
| pPSA | 0.99 (0.77-1.26) | 0.92 | 0.75 (0.52-1.07) | 0.11 |
| Pathologic GS ≥ 8 | 3.02 (1.61-5.68) | p < 0.001 | 1.91 (0.85-4.33) | 0.12 |
| SVI | 2.44 (1.30-4.58) | 0.01 | 1.93 (0.79-4.73) | 0.15 |
| Tumor Volume | 1.02 (0.97-1.06) | 0.44 | 0.97 (0.92-1.04) | 0.42 |
| N+ | 1.69 (0.74-3.88) | 0.21 | 1.42 (0.41-4.96) | 0.58 |
| SM+ | 1.05 (0.57-1.93) | 0.87 | 0.93 (0.40-2.17) | 0.87 |
| ECE | 2.01 (1.18-3.73) | 0.03 | 1.00 (0.45-2.20) | 0.99 |

* MVA adjusted for adjuvant and salvage treatment interventions

TABLE 13

|  | Hazard Ratio (95% CI) | P |
| --- | --- | --- |
| GC [1] | 1.47 (1.26-1.73) | <0.001 |
| Pathological Gleason Score* | | |
| 6 + 7(3 + 4) | ref | |
| 7(4 + 3) | 3.30 (1.21-9.04) | 0.02 |
| 8 | 3.99 (1.48-10.77) | 0.01 |
| 9-10 | 2.21 (0.78-6.25) | 0.14 |
| Pre-operative Prostate-specific Antigen [2] | 1.23 (0.81-1.85) | 0.34 |
| Seminal Vesicle Invasion | 2.05 (0.85-4.98) | 0.11 |
| Positive Surgical Margin | 1.21 (0.55-2.67) | 0.64 |
| Extra-capsular Extension | 1.29 (0.55-3.01) | 0.56 |
| Lymph Node Involvement | 0.75 (0.21-2.70) | 0.66 |
| Adjuvant Radiation | 0.87 (0.23-3.32) | 0.83 |
| Adjuvant Hormone | 0.88 (0.35-2.24) | 0.79 |

*Reference Gleason score combined 6 and 3 + 4 as model did not converge with using Gleason 6 only as reference
[1] Hazard ratio reported for 10% increase of GC score.
[2] Hazard ratio reported for 1.0 unit increments of log-transformed level.
Abbreviations - CI: confidence interval; GC: genomic classifier.

TABLE 14

|  |  | Hazard Ratio (95% CI) | P |
| --- | --- | --- | --- |
| Model | GC [1] | 1.49 (1.27-1.73) | <0.001 |
|  | Stephenson [1] | 1.15 (1.01-1.31) | 0.04 |

[1] Hazard ratio reported for 10% increase of GC score.
Abbreviations - CI: confidence interval; GC: genomic classifier To investigate the magnitude of the hazards ratio for incremental increases in GC score we evaluated the effect size of each 10% increase in GC score for predicting clinical metastasis after adjusting for postoperative treatment (Table 15). We observed a general trend of increasing HR, and decreasing probability of metastasis-free survival with increasing deciles. However, this was not statistically significant because of the small number of patients, in the higher GC deciles. GC score deciles were then incrementally collapsed to create three GC risk groups (GC scores<0.4, 0.4-0.6, ≥0.6) and these showed significant differences in HR (and survival) in comparison to the reference group as well as to the prior level (Table 16).

TABLE 15

| GC Deciles | % of Patients | ref = first GC decile HR (95% CI) | P | ref = prior GC decile HR (95% CI) | P | Clinical Metastasis-free Probability 3-year | 5-year | 8-year |
|---|---|---|---|---|---|---|---|---|
| 0.00000-0.1 | 10 | NA | NA | | | 100% | 98% | 98% |
| 0.10001-0.2 | 17% | 0.60 (0.04-10.20) | 0.72 | 0.60 (0.04-10.20) | 0.72 | 100% | 100% | 99% |
| 0.20001-0.3 | 19% | 5.56 (0.66-47.14) | 0.12 | 9.28 (1.13-76.08) | 0.04 | 100% | 97% | 92% |
| 0.30001-0.4 | 13% | 5.86 (0.64-53.68) | 0.12 | 1.05 (0.33-3.32) | 0.93 | 96% | 95% | 92% |
| 0.40001-0.5 | 12% | 6.06 (0.68-53.89) | 0.11 | 1.04 (0.29-3.74) | 0.96 | 96% | 95% | 90% |
| 0.50001-0.6 | 9% | 11.12 (1.25-99.33) | 0.03 | 1.83 (0.52-6.49) | 0.35 | 96% | 92% | 80% |
| 0.60001-0.7 | 12% | 17.35 (2.06-146.25) | 0.009 | 1.56 (0.52-4.71) | 0.43 | 89% | 86% | 77% |
| 0.70001-0.8 | 4% | 16.68 (1.62-171.63) | 0.02 | 0.96 (0.24-3.84) | 0.96 | 87% | 78% | NA* |
| 0.80001-0.9 | 2% | 95.51 (8.82-1034.17) | <0.001 | 5.73 (0.97-33.63) | 0.05 | 65% | NA* | NA* |
| 0.90001-1.0 | 1% | 106.63 (11.20-1014.70) | <0.001 | 1.12 (0.21-5.83) | 0.9 | 80% | NA* | NA* |

*Model adjusted for adjuvant treatment
**No patients left due to censoring or experiencing clinical metastasis events

TABLE 16

| GC risk categories | % of Patients | reference GC < 0.4 Hazard Ratio (95% CI) | P | reference = prior GC group Hazard Ratio (95% CI) | P | Clinical Metastasis-free Probability 3-year | 5-year | 8-year |
|---|---|---|---|---|---|---|---|---|
| <0.4 | 60% | NA | NA | | | 99% | 98% | 95% |
| 0.4-0.6 | 21% | 2.39 (1.10-5.17) | 0.03 | 2.39 (1.10-5.17) | 0.03 | 96% | 94% | 87% |
| >0.6 | 19% | 7.30 (3.51-15.14) | <0.001 | 3.06 (1.40-6.72) | 0.005 | 86% | 78% | 73% |

Model adjusted for adjuvant treatments

Figure 33:
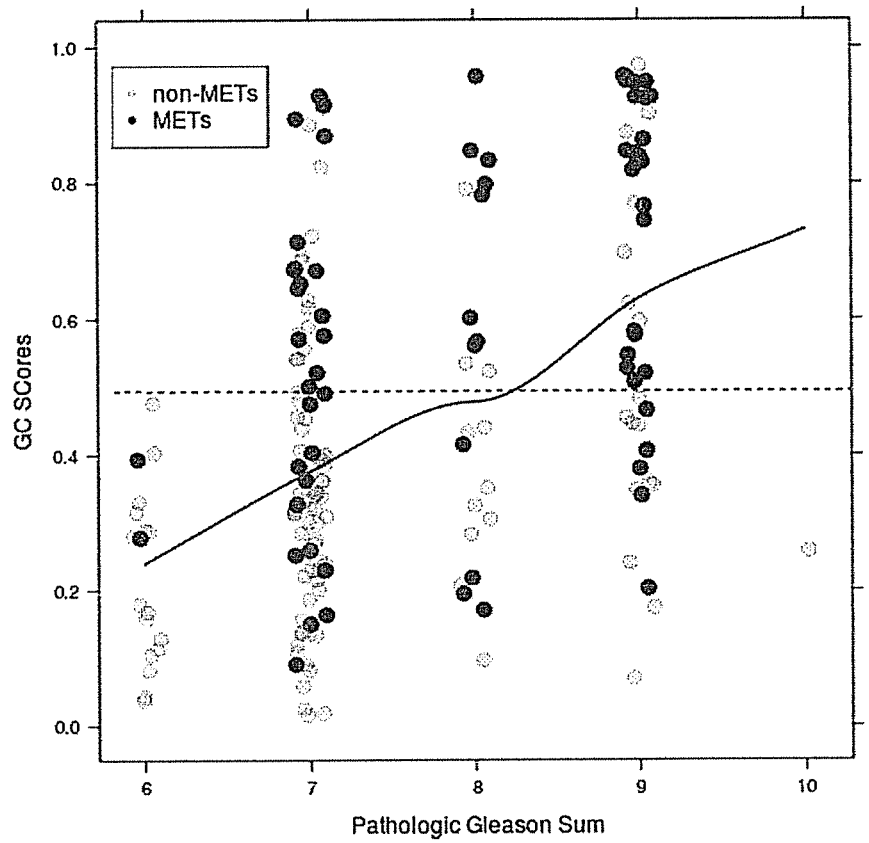
FIG. 33. Distribution of GC scores among pathologic GS categories in testing. GC scores are plotted with a jitter so as to more easily differentiate the patients among each Pathologic GS (x-axis) groups. Cases (black) and controls patients (gray) are shown for each category. The dashed black line indicates the GC cutoff of 0.5. Trends show the patients with high GC scores tend to have high Gleason Scores as well.
Figure 34:
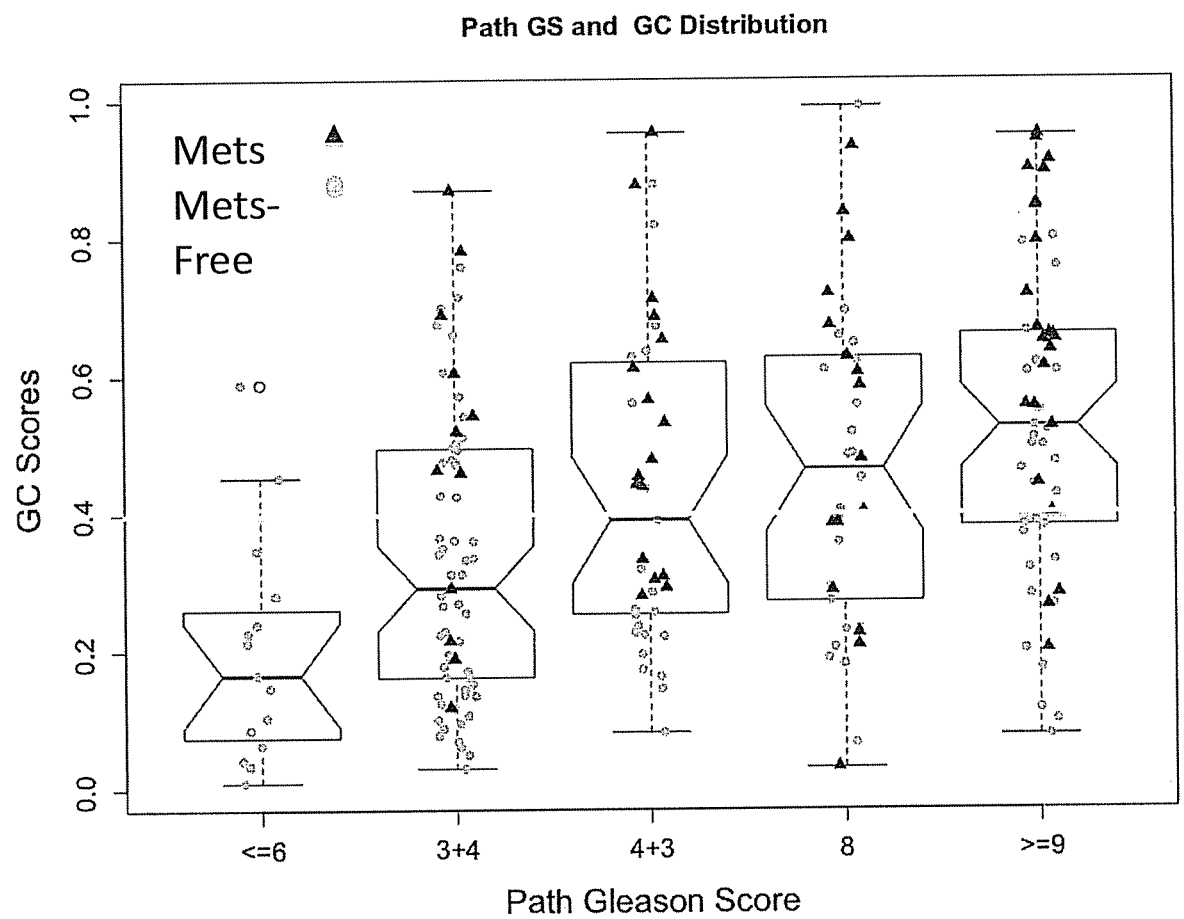
FIG. 34. Distribution of GC scores among pathologic GS categories in the independent validation set. METS=triangle, METS-free=circle FIGS. 35A-C. Prostate Cancer Specific Mortality Kaplan-Meier Plots on Training and Testing Sets.

The distribution of cases and controls in the testing set by both GC and Gleason score risk groups was illustrated in FIG. 33 and summarized in Table 17. Among GS≤6 tumors (n=18) none had high GC scores, while among GS 7 tumors (n=97), nearly a third (29%) had high GC scores and half of these were cases that developed early metastasis after rising PSA. While most patients with high Gleason scores (≥8) had high GC scores, among the 29 (40%) with low GC scores there were only 7 cases with 3 deaths from prostate cancer. Overall, 116 out of 186 (62%) testing set patients had low GC scores of which only 21 were cases resulting in 7 deaths from prostate cancer. Among the 70 (38%) patients with high GC scores, there were 42 cases and 25 of these men died of prostate cancer. In the independent validation set, GC distribution in Gleason score groups showed high concordance (FIG. 34, Table 18); still GC identified significant number of clinically high risk patients who did not experience adverse outcomes in this set. Among patients with low Gleason score (GS 5 to 6), none had high GC scores (≥0.6) or had clinical metastasis on study follow up. As expected, 40% of patients with GS≥8 had high GC scores (≥0.6), of whom 62% experienced metastasis and 41% died of their disease. However, more than a third of patients with GS≥8 (36%) had low GC scores (<0.4), and the majority of these men did not have metastasis (77%) or die of prostate cancer (85%) at follow up. Among patients with GS 7 tumors, 41% had high GC scores (≥0.4) and 44% of these men had clinical metastasis but for GS 7 with low GC scores (<0.4), 86% of them did not metastasize and only 3% died of their disease. This reclassification demonstrated that while GC scores trend higher with higher Gleason score, GC may be used to further identify a considerable number of men with 'high risk' Gleason≥8 tumors that may never develop clinical metastasis and conversely from among 'intermediate risk' Gleason 7 tumors a subset enriched for clinical metastasis events.

TABLE 17

| | GC ≤ 0.5 | | | GC > 0.5 | | |
|---|---|---|---|---|---|---|
| Gleason Category | n | n METs (%*) | n PCSM (%) | n | n METs (%) | n PCSM (%) |
| GS ≤ 6 | 18 | 2 (11) | 0 | 0 | 0 | 0 |
| GS 7 | 69 | 12 (17) | 4 (5.7) | 28 | 14 (50) | 4 (14) |
| GS 8 | 12 | 4 (33) | 1 (8.3) | 11 | 6 (54) | 5 (45) |
| GS ≥ 9 | 17 | 3 (17) | 2 (12) | 31 | 22 (70) | 16 (51) |

TABLE 18

| Path GS Categories | GC Score < 0.4 | | | 0.4 ≤ GC Score ≤ 0.6 | | | GC Score > 0.6 | | | |
|---|---|---|---|---|---|---|---|---|---|---|
| | Total N (%) | Mets | PCSM | Total N (%) | Mets | PCSM | Total N (%) | Mets | PCSM | TOTAL |
| 5-6 | 13 (87) | 0 | 0 | 2 (13) | 0 | 0 | 0 (0) | 0 | 0 | 15 |
| 7 | 66 (59) | 9 | 2 | 24 (22) | 10 | 1 | 21 (19) | 10 | 3 | 111 |
| 8 | 16 (42) | 6 | 2 | 9 (24) | 3 | 1 | 13 (34) | 7 | 6 | 38 |
| 9-10 | 17 (31) | 4 | 3 | 14 (25) | 4 | 1 | 24 (44) | 16 | 9 | 55 |
| TOTAL N | 112 (51) | 19 | 7 | 49 (22) | 17 | 3 | 58 (27) | 33 | 18 | 219 |

Figure 35A:
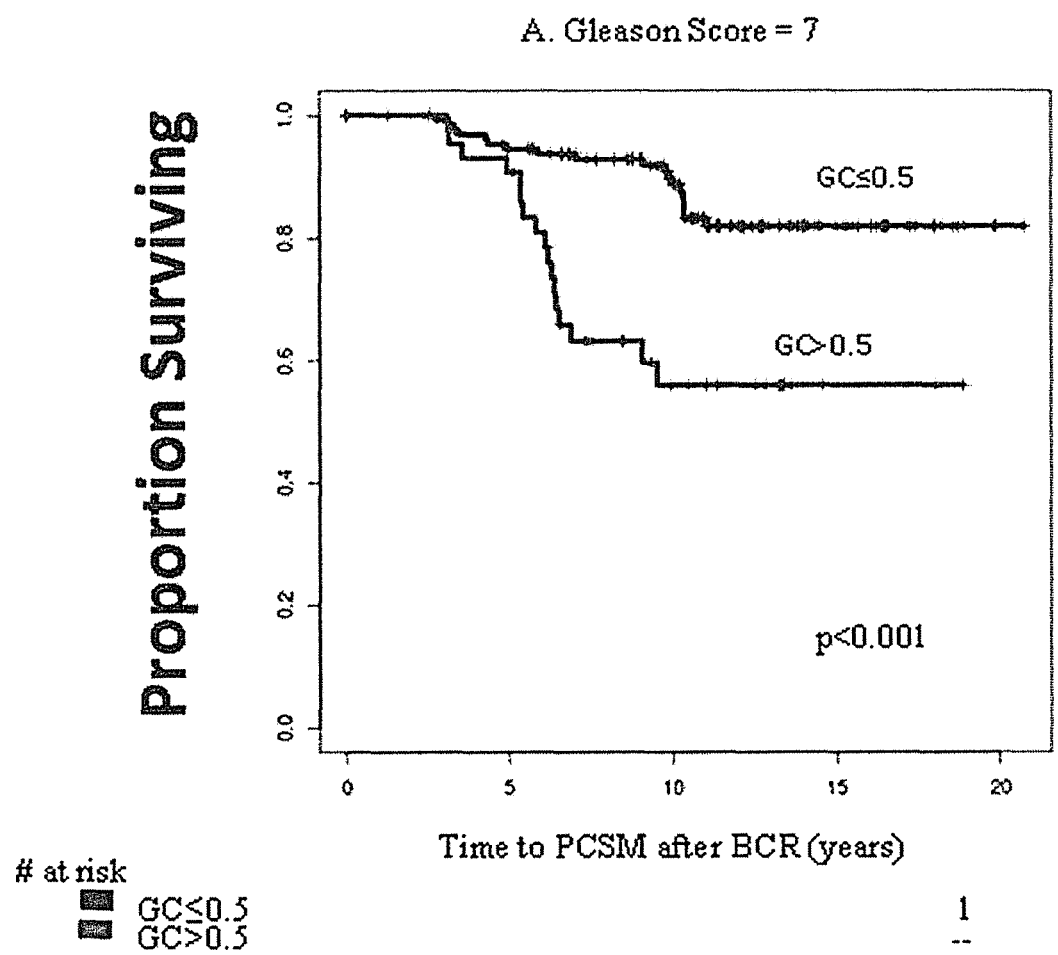
FIG. 35A—Gleason Score=7.
Figure 35B:
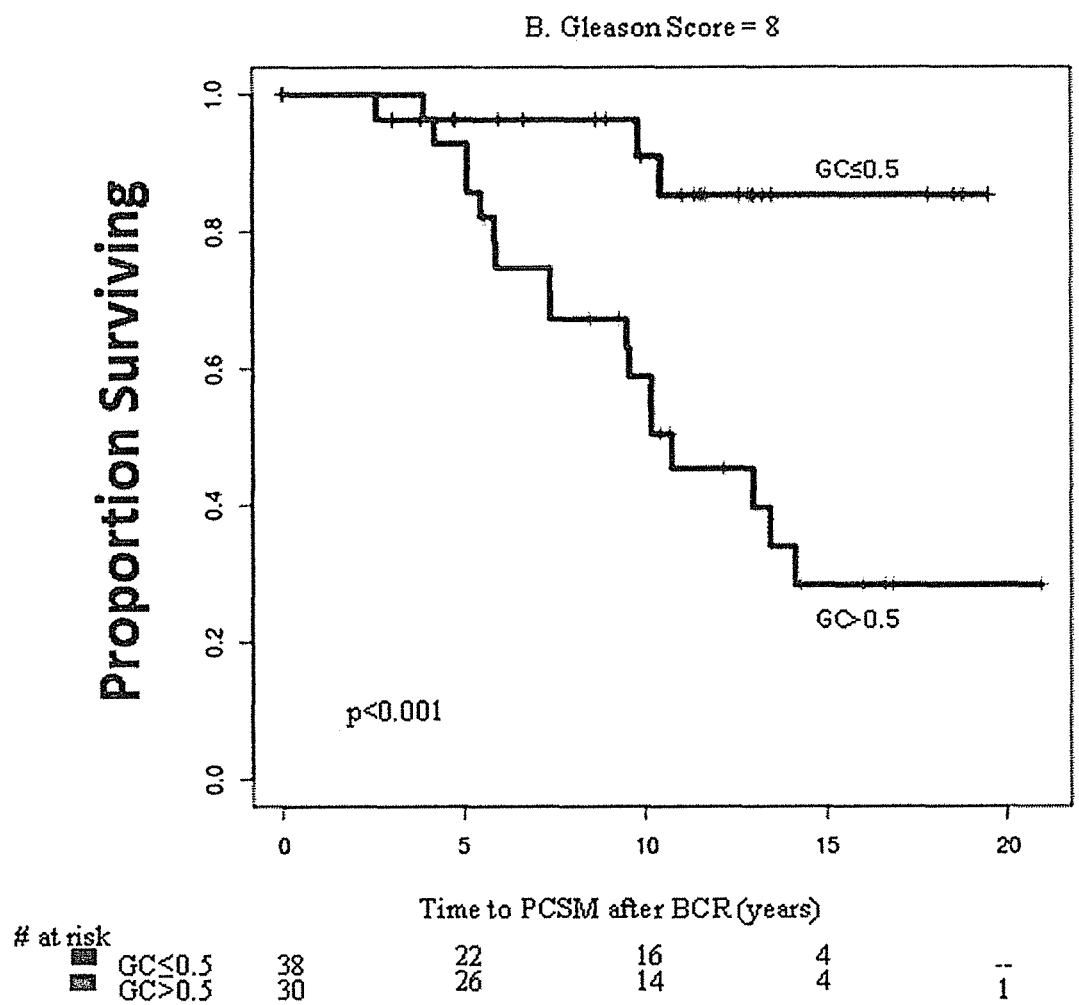
FIG. 35B—Gleason Score=8.
Figure 35C:
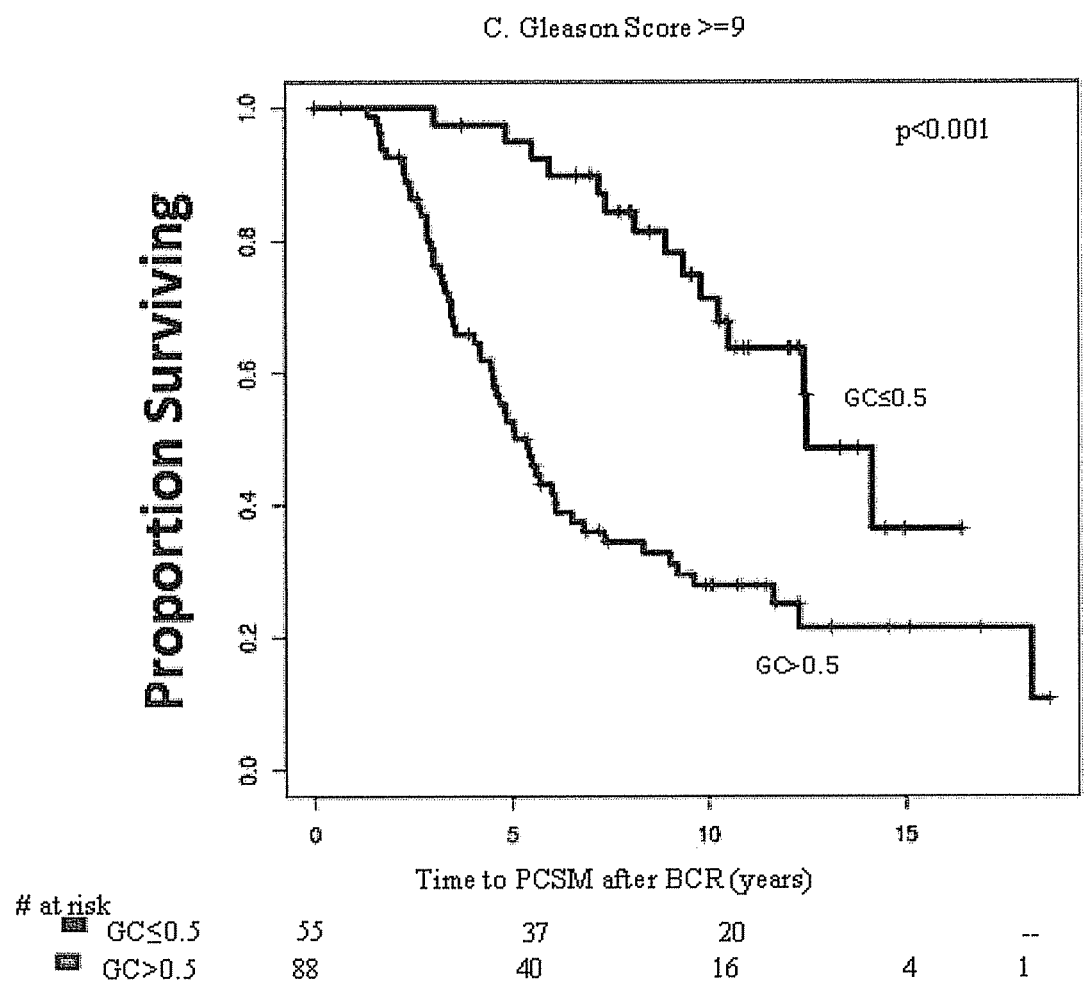
FIG. 35C—Gleason Score>=9.
Figure 36:
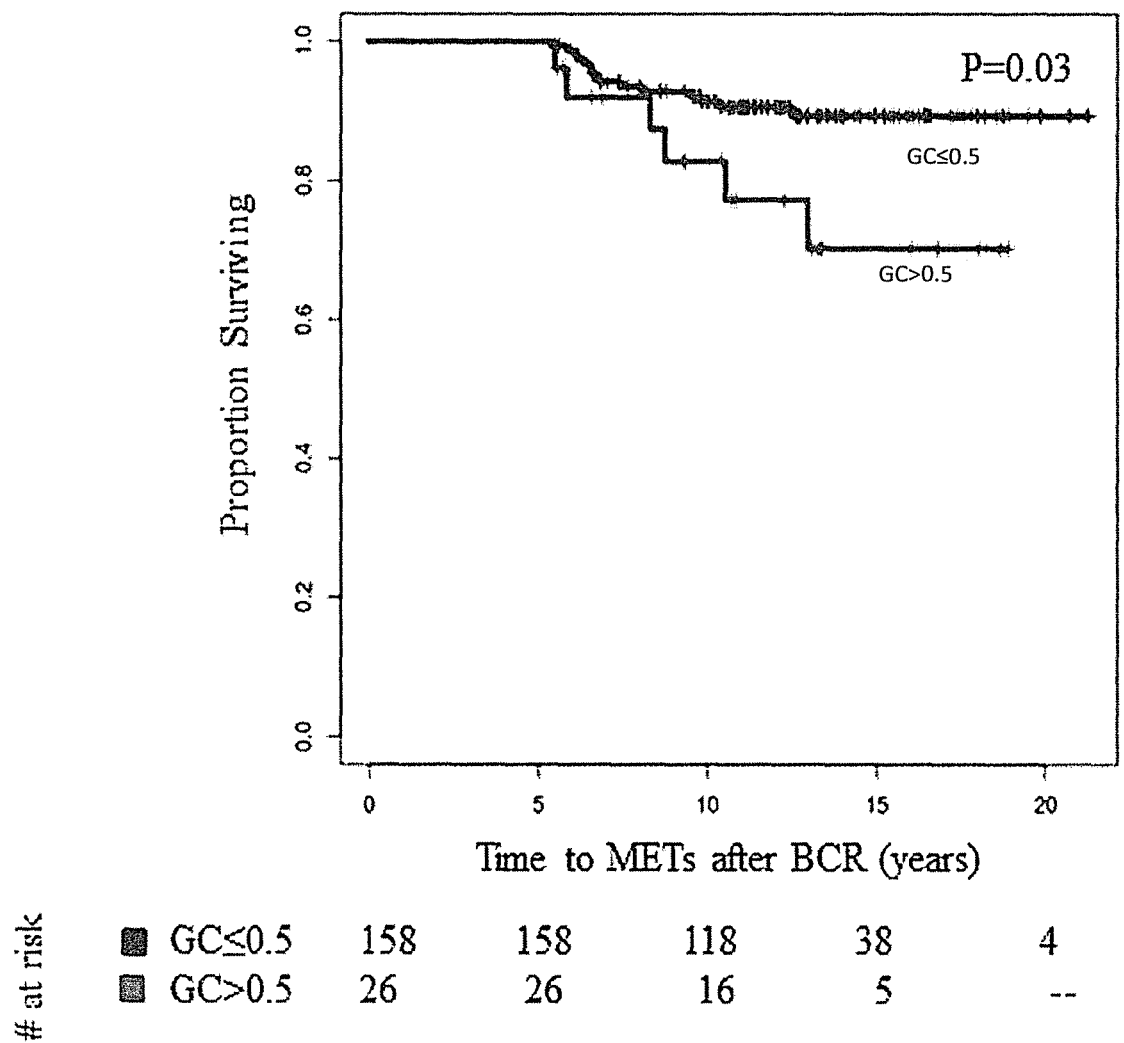
FIG. 36. Kaplan Meier estimates for all PSA Controls with metastasis endpoint. PSA controls were separated into two groups based on high (>0.5) or low risk according to GC. Log-rank p-values are shown in the upper right corner.

The clinical significance of GC was further evidenced by the statistically significant differences of low and high-risk GC groups for the Prostate Cancer Specific Mortality Endpoint (PCSM) found within different Gleason Score Risk Groups (FIGS. 35A-C and Table 19). Also, GC was able to significantly (p<0.05) separate those PSA patients that would go on to experience later clinical metastasis (FIG. 36). As the KM method not only takes into consideration the number of patients at risk but also censored data (e.g., patients for which there was a loss of follow up at some point in time) to compute the proportions, the number of patients at risk for each time point in FIG. 35-36 are shown in Tables 19-20, respectively. These results suggested that GC can accurately predict metastasis long before it can be detected radiographically, may better guide post-surgical treatment decisions, and may help prevent over-treatment, toxicity, and morbidity.

TABLE 19

| | | Time to PCSM after BCR (years) | | | | | |
|---|---|---|---|---|---|---|---|
| | | 0 | 5 | 10 | 15 | 20 | |
| on Score = 7 | GC ≤ 0.5 | 217 | 118 | 85 | 24 | 1 | # Patients at risk |
| | GC > 0.5 | 54 | 39 | 14 | 2 | — | |
| Gleason Score = 8 | GC ≤ 0.5 | 38 | 22 | 16 | 4 | — | |
| | GC > 0.5 | 30 | 26 | 14 | 4 | 1 | |
| Gleason Score = 9 | GC ≤ 0.5 | 55 | 37 | 20 | 1 | — | |
| | GC > 0.5 | 88 | 40 | 16 | 4 | 1 | |

TABLE 20

| | Time to PCSM after BCR (years) | | | | | |
|---|---|---|---|---|---|---|
| | 0 | 5 | 10 | 15 | 20 | |
| GC ≤ 0.5 | 158 | 158 | 118 | 38 | 4 | # Patients at risk |
| GC > 0.5 | 26 | 26 | 16 | 5 | — | |

Example 9: Combined Value of Genomic Biomarkers and CAPRA-S in Predicting Prostate Cancer Death in a High-Risk Surgical Cohort Most men with lethal prostate cancer present initially with localized disease, and develop biochemical recurrence (BCR) following local treatment. Biomarkers potentially improve prediction of progression risk after radical prostatectomy (RP). We compared two validated post-RP classifiers: a genomic classifier (GC) and CAPRA-S(based on standard clinicopathologic parameters), to predict cancer-specific mortality (CSM) in a contemporary cohort of RP patients.

Materials and Methods

Patient Population

Subjects were identified from a population of 1,010 men prospectively enrolled in the Mayo Clinic tumor registry who underwent RP for prostatic adenocarcinoma from 2000-2006 (see Example 1). This population was clinically high-risk for metastasis, as defined by pre-operative prostate-specific antigen (PSA) levels>20 ng/mL, pathological Gleason score≥8, Seminal Vesicle Invasion (SVI), or GPSM (Gleason score; pre-operative PSA; SVI; surgical margin status, SMS) score≥10. Data was collected using a case-cohort design; of the 1,010 men, 73 (7.2%) patients developed metastatic disease as evidenced by bone and/or CT scans. These 73 men were defined as cases. A 20% random sample of the entire cohort was selected for analysis (202 patients), which included 19 cases. The remaining 54 cases not selected by random sampling were also included for analysis, resulting in a total of 256 patients. After exclusion for tissue unavailability and quality control, the independent validation cohort consisted of 219 patients (69 cases and 150 controls; median follow-up, 6.69 years).

Tissue Processing

Following histopathological review, total RNA was extracted and amplified from macrodissected FFPE primary prostatic adenocarcinoma specimens, and hybridized to Human Exon 1.0 ST GeneChips (Affymetrix, Santa Clara, Calif.) that profile coding and non-coding regions of the transcriptome using approximately 1.4 million probe selection regions, hereafter referred to as features.

Classifier Development

We compared and integrated two validated post-RP classifiers: GC and CAPRA-S. The GC was developed using a nested-case control study and contains the 22 biomarker set as disclosed in Example 3. The primary endpoint of GC was metastatic disease progression, defined as a positive bone or CT scan. Patients with GC scores≥0.4 were considered at high risk of progression to metastases. GC was independently validated in follow-up blinded study, of the patient population presented here. CAPRA-S is a nomogram that is based on standard clinical parameters, developed using the CAPSURE registry and biochemical recurrence (BCR) as the primary endpoint (Cooperberg, M. R., et al, The CAPRA-S score: A straightforward tool for improved prediction of outcomes after radical prostatectomy. Cancer, 117(22), 5039-46). CAPRA-S scores≥6 were considered at higher risk of BCR. Out of the 219 patients, 212 had sufficient data with which to calculate the CAPRA-S score. Of these, 28 had CSM events.

GC and CAPRA-S were integrated using a cox-proportional hazard model with prostate cancer specific mortality (CSM) as the primary endpoint. Although GC and CAPRA-S classifiers were developed for different endpoints (metastases and BCR, respectively), high scores in these models could translate to greater risk of CSM. Neither GC nor CAPRA-S were trained or further refined on this patient population and the raw classifier scores were used for an integrated genomic and clinical classifier. This integrated genomic-clinical classifier, characterized by the equation 0.20*CAPRA-S+5.68*GC, was validated using the optimism estimate of the c-index (calculated by bootstrapped validation), and its performance was further evaluated in an independent low risk patient population.

Statistical Analysis

The area under the receiver operating characteristic (ROC) curve was used to initially compare classifier performance to predict metastasis. Calibration plots, ROC curves and decision curves were used to assess overall discrimination. Survival decision curve analysis was used to compare the net benefit (e.g., gain in sensitivity weighted by loss in specificity) over a range of "decision-to-treat" threshold probabilities using the GC and CAPRA-S classifiers. The decision curve was evaluated for prediction of CSM within 5 years post-RP.

Cox proportional hazards analysis was used to test for associations between classifiers and adverse pathologic features (APFs) for the CSM endpoint. The proportional hazard analysis used a Barlow weighting scheme to account for the case-cohort design of the study, the Lin-Ying method was used to refine estimates of the variance. Cumulative incidence curves were constructed using Fine-Gray competing risks analysis to accommodate censoring due to death. Analyses were performed using R v2.14.1.

Results

Figure 37:
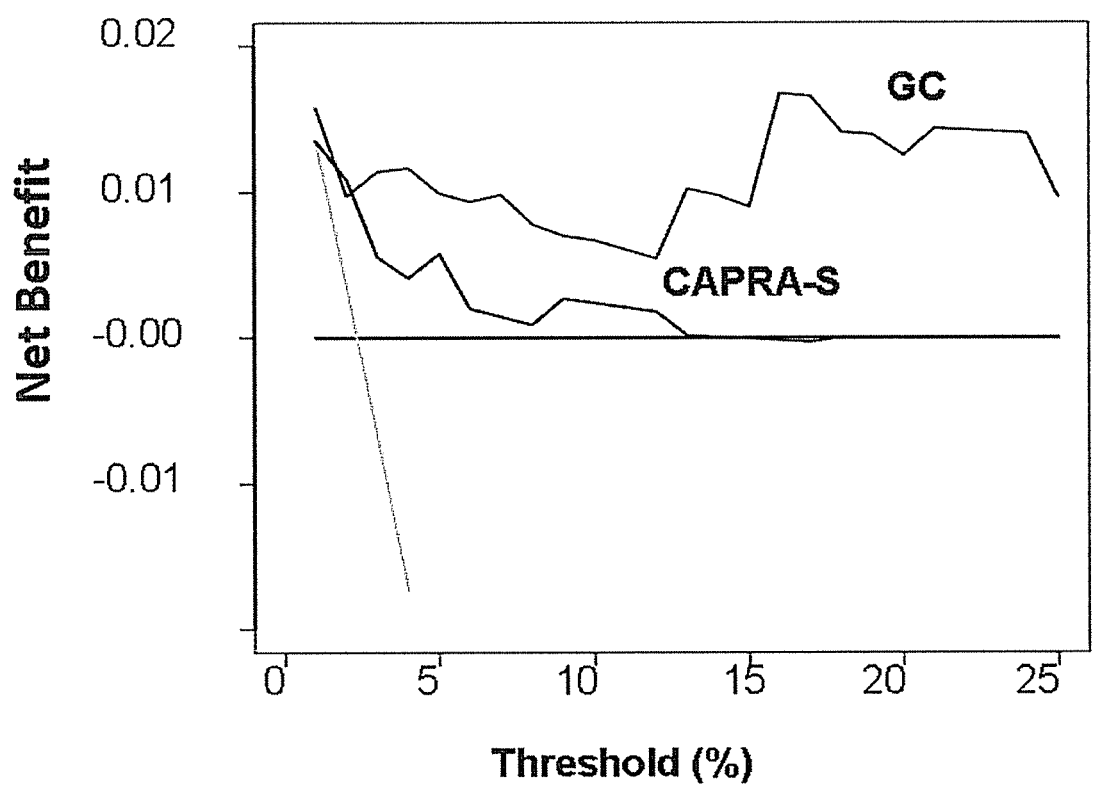
FIG. 37. Survival decision curve analysis of GC and CAPRA-S.

Table 21 shows the clinical characteristics of the cohort used for this study. The high number of metastasis and CSM events demonstrated the high risk of this cohort. CAPRA-S and GC were the most prognostic indicators of CSM by survival ROC analysis (Table 22). GC had a survival AUC of 0.78 (0.65-0.89 95% CI) whereas CAPRA-S had a survival AUC of 0.76 (0.65-0.88 95% CI). Survival decision curve analysis (FIG. 37) showed that GC had a higher Net Benefit over a range of "decision-to-treat" threshold probabilities.

TABLE 21

|  | Total n (%) |
|---|---|
| Pre-operative Prostate-specific Antigen | |
| <10 ng/mL | 119 (54) |
| 10-20 ng/mL | 59 (27) |
| >20 ng/mL | 41 (19) |
| Pathological Gleason Score | |
| ≤6 | 15 (7) |
| 7 | 111 (51) |
| ≥8 | 93 (42) |
| Pathological Stage | |
| pT2N0M0 | 85 (39) |
| pT3/4N0M0 | 102 (47) |
| pTanyN + M0 | 32 (15) |
| Adverse Pathologic Features | |
| Positive surgical margins | 123 (56) |
| Extra-capsular extension | 95 (43) |
| Seminal vesicle invasion | 81 (37) |
| Post-Operative Treatment | |
| Adjuvant radiation | 24 (11) |
| Adjuvant androgen deprivation therapy | 74 (34) |
| Salvage radiation | 68 (31) |
| Salvage androgen deprivation therapy | 86 (39) |

TABLE 21-continued

|  | Total n (%) |
|---|---|
| Clinical Outcomes | |
| Biochemical recurrence | 110 (50) |
| Clinical metastasis | 69 (31) |
| Prostate cancer-specific mortality | 28 (13) |

TABLE 22

|  | Survival AUC (95% CI) |
|---|---|
| GC | 0.78 (0.65-0.89) |
| CAPRA-S | 0.76 (0.65-0.88) |
| Pathologic Gleason Score | 0.73 (0.63-0.84) |
| Pre-operative PSA | 0.48 (0.33-0.56) |
| Positive Margins | 0.51 (0.35-0.65) |
| Lymph Nodes | 0.62 (0.46-0.72) |
| Seminal Vesicle Invasion | 0.60 (0.42-0.70) |
| Extra Capsular Extension | 0.48 (0.33-0.56) |

Figure 38:
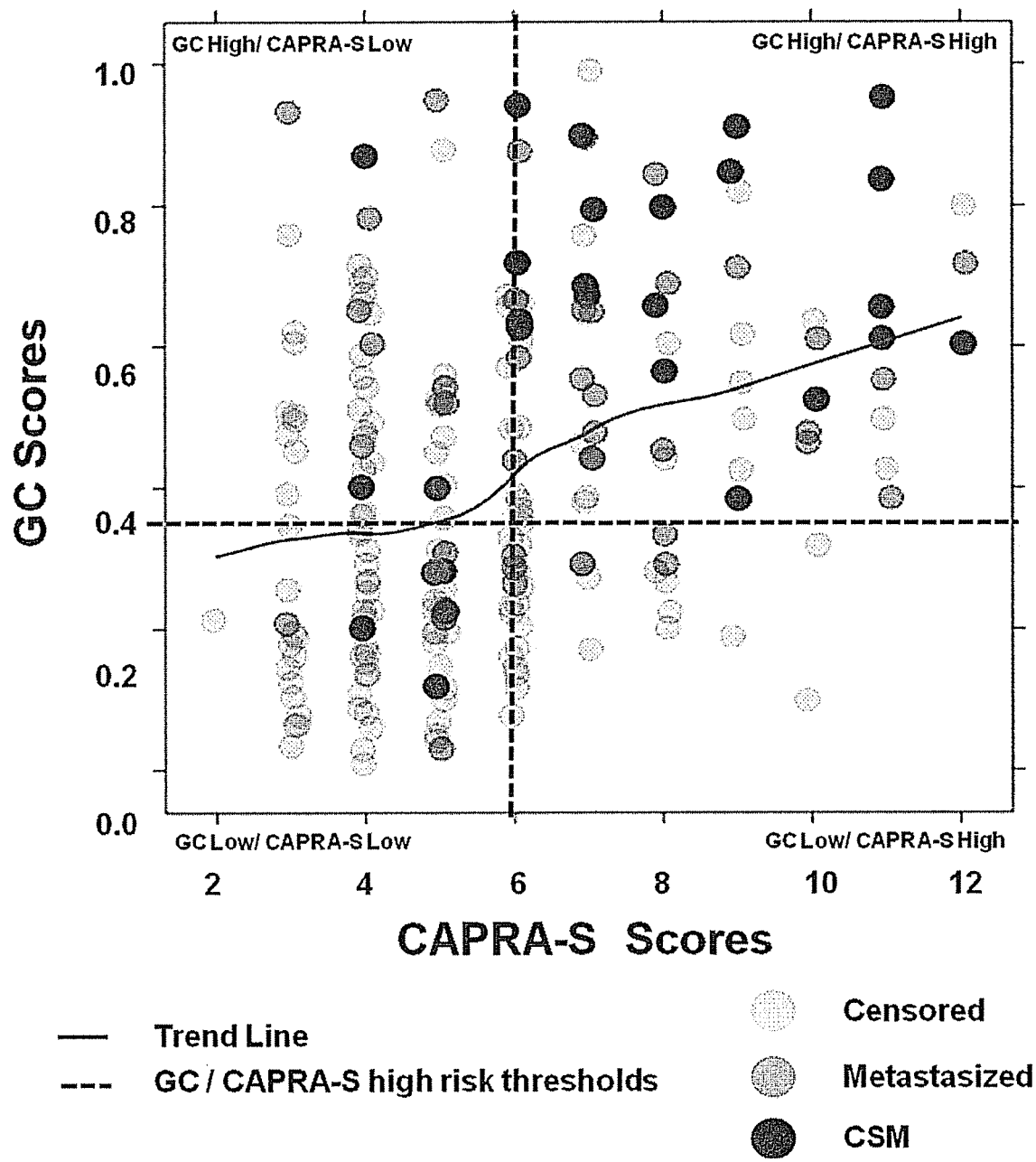
FIG. 38. Distribution of GC scores among CAPRA-S score categories.

When GC and CAPRA-S scores were compared, while trends suggest that both GC and CAPRA-S had high agreement with respect to patients that are truly at risk of lethal prostate cancer (FIG. 38), there was also substantial reclassification of CAPRA-S risk categories by GC. Namely GC was more specific as it reclassified 108 patients to lower risk without significantly impacting sensitivity (Table 23).

TABLE 23

|  | GC Score <0.4 | | GC Score ≥0.4 | | |
|---|---|---|---|---|---|
| CAPRA-S risk | Total Patients n | Total CSM n (csm total %) | Total Patients n | Total CSM n (csm total %) | Total |
| ≤2 | 1 | n.a | n.a | n.a | 1 |
| 3 to 5 | 68 | 6 (8.8) | 40 | 2 (5.0) | 108 |
| ≥6 | 39 | 1 (2.5) | 64 | 19 (30) | 103 |
| Total | 108 | 7 | 104 | 21 | 212 |

Figure 39A:
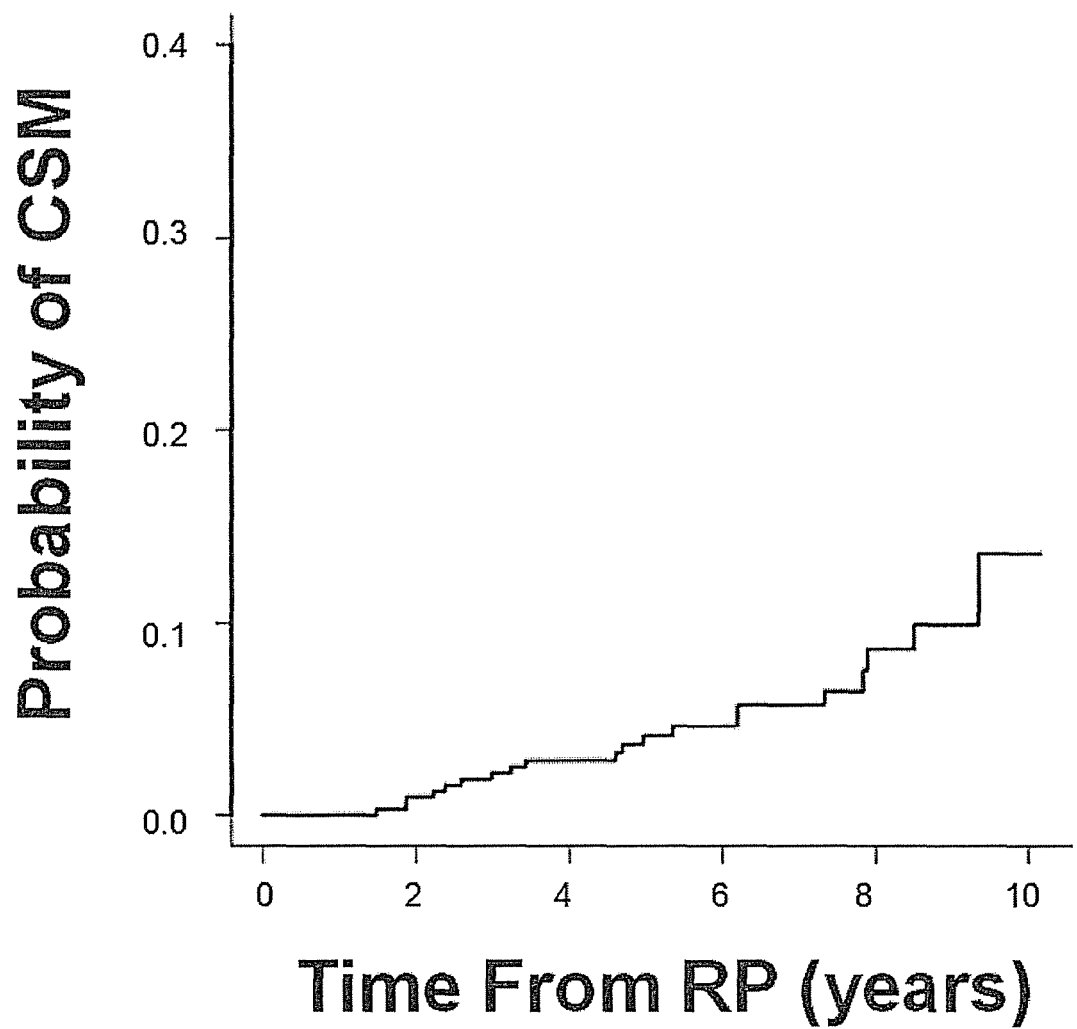
FIGS. 39A-B. The cumulative incidence plot for the CAPRA-S high risk group (A) and stratified by GC score (B).
Figure 39B:
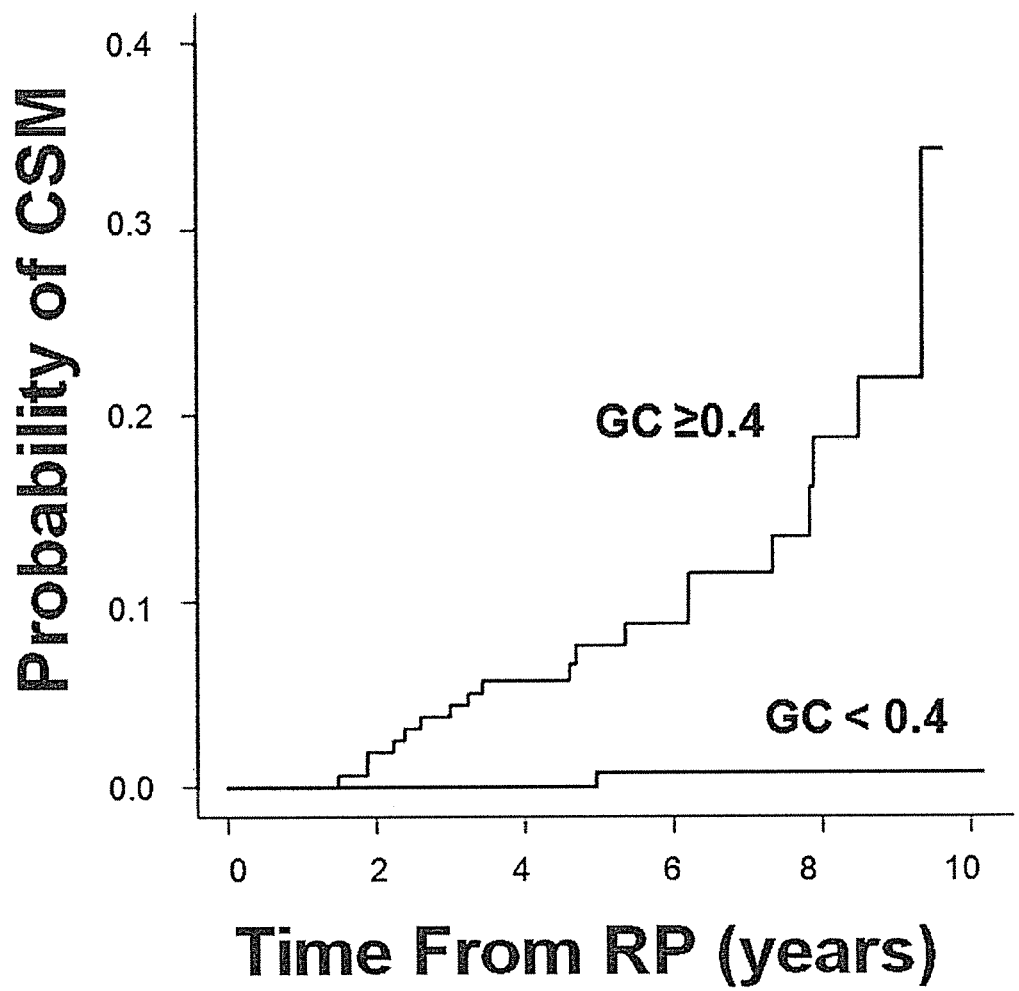

The cumulative incidence plot (accounting for other causes of death as a competing risk) for the CAPRA-S high risk group was shown (CAPRA-S≥6; FIG. 39A). When this group was stratified by GC (FIG. 39B), patients with both high CAPRA-S scores and GC scores were at considerably higher risk than those with low GC scores.

Univariable (UVA) and Multivariable analysis (MVA) was used to further assess the statistical significance of the classifiers and clinical variables individually (UVA) and in presence of other variables (MVA). As shown in Table 24, GC, CAPRA-S and pathological Gleason Score were highly statistically significant in UVA (p-value<0.001), whereas Lymph Node Involvement and Extra capsular Extension were significant (p-value=0.01). In MVA, while CAPRA-S was not included in multivariable analysis as the clinicopathologic factors in this analysis comprise CAPRA-S, only GC and pathological Gleason Score remained statistically significant (Table 24).

TABLE 24

| | Univariable Analysis | | Multivariable Analysis | |
|---|---|---|---|---|
| | Hazard Ratio (95% CI) | p-value | Hazard Ratio (95% CI) | p-value |
| GC* | 1.83 (1.42-2.36) | p < 0.001 | 1.61 (1.24-2.10) | p < 0.001 |
| CAPRA-S** | 1.42 (1.19-1.70) | p < 0.001 | n.a | n.a |
| Path Gleason Score | 7.84 (2.80-21.97) | p < 0.001 | 4.80 (1.38-16.71) | 0.01 |
| Pre-operative PSA | 1.11 (0.79-1.56) | 0.54 | 1.01 (0.60-1.70) | 0.96 |
| Positive Margins | 0.66 (0.29-1.52) | 0.33 | 0.50 (0.18-1.38) | 0.18 |
| Lymph Nodes | 3.53 (1.36-9.16) | 0.01 | 1.45 (0.43-4.91) | 0.55 |
| Seminal Vesicle Invasion | 2.11 (0.92-4.86) | 0.08 | 1.79 (0.60-5.29) | 0.29 |
| Extra Capsular Extension | 3.52 (1.40-8.81) | 0.01 | 2.11 (0.69-6.42) | 0.19 |

Figure 40A:
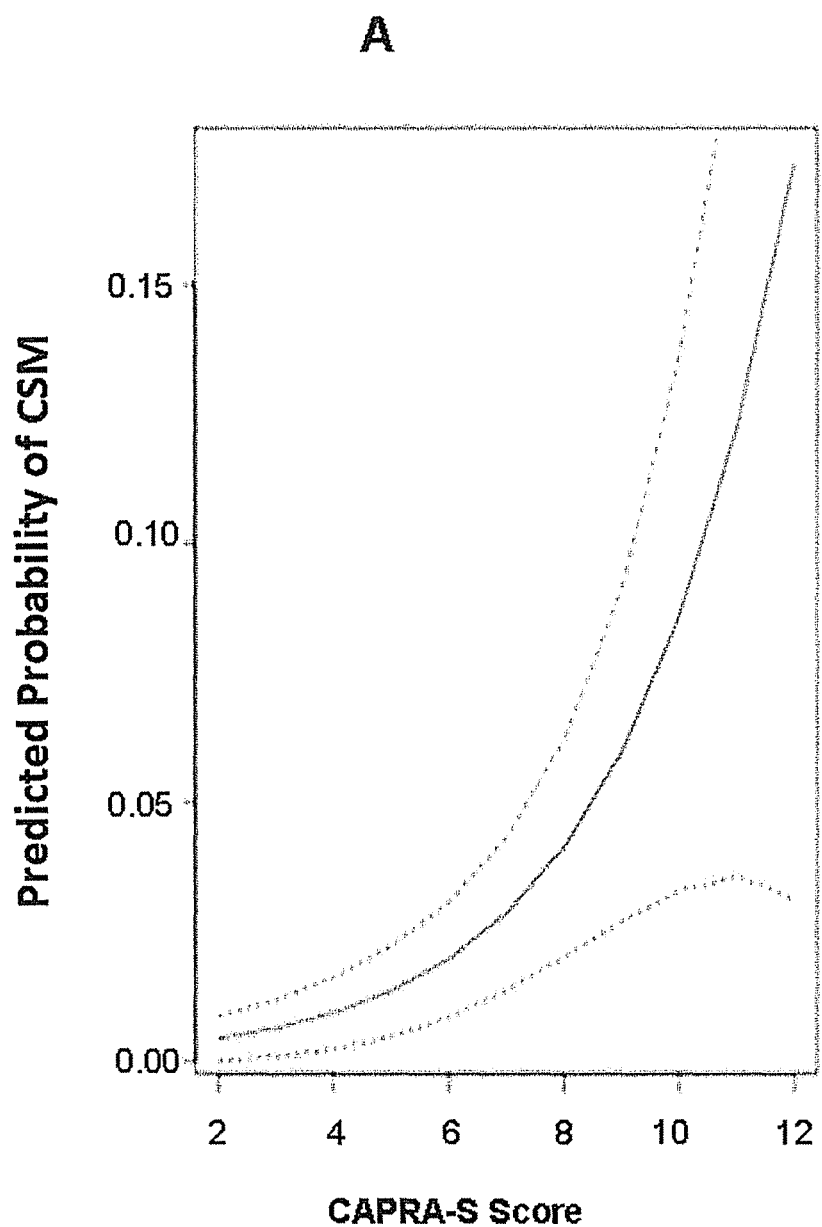
FIGS. 40A-C. Prediction Curve for GC, CAPRA-S and an integrated genomic-clinical model. (A) CAPRA-S; (B) GC; (C) Integrated Genomic-Clinical model.
Figure 40B:
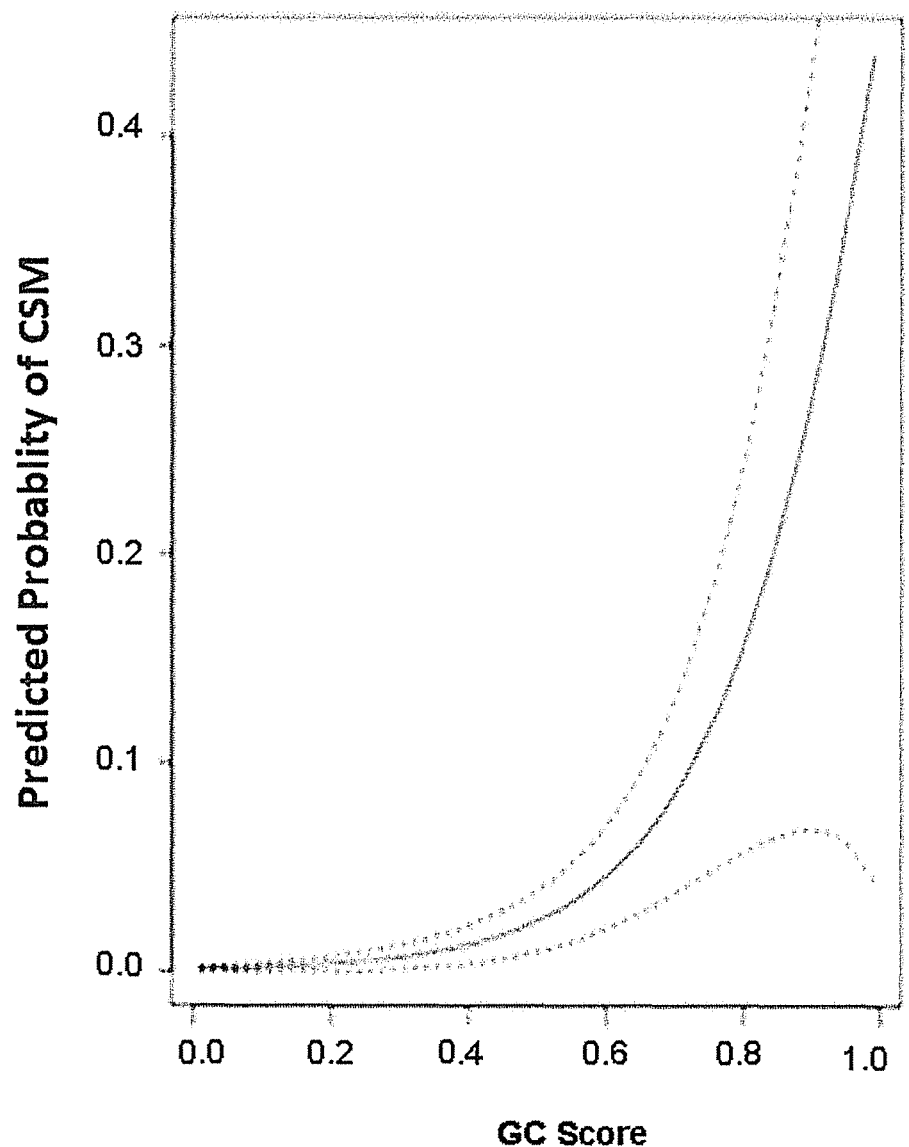
Figure 40C:
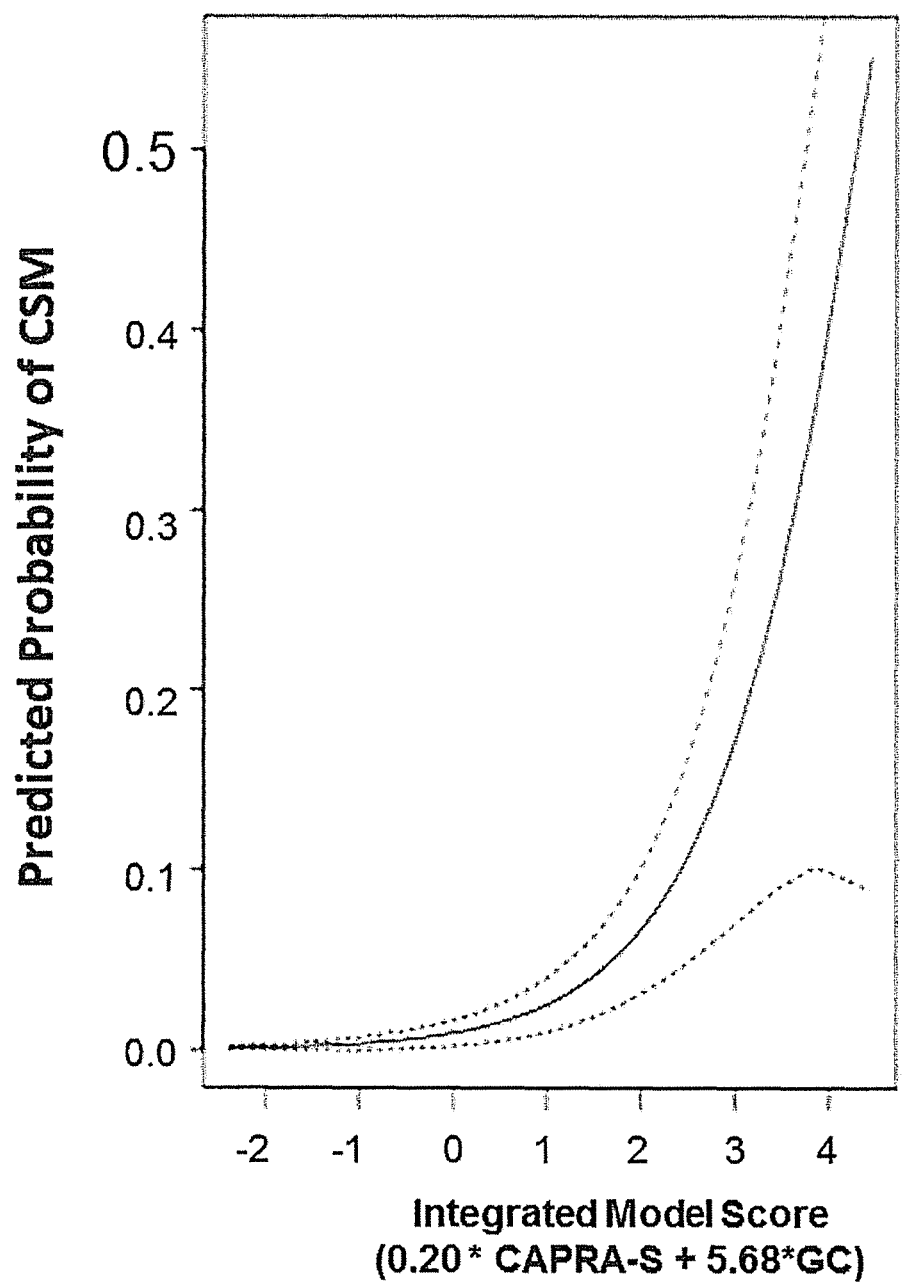

*GC hazard ratio is adjusted for a step size of 0.1
**CAPRA-S is not included in multivariable analysis as the clinicopathologic factors in this analysis comprise CAPRA-S A second MVA between GC and CAPRA-S suggested both GC (HR:1.62, p<0.001) and CAPRA-S(HR:1.22, p=0.01) offered independent and statistically significant prognostic information. An integrated model improved risk stratification over either model alone (FIG. 40).

In summary, among men treated with RP at high risk of recurrence based on clinicopathologic variables, both GC and CAPRA-S were significant predictors of CSM. GC was able to effectively 'down-risk' men stratified to high risk based on CAPRA-S alone. GC provided independent prognostic information, and a model integrating GC and CAPRA-S may further improve prediction of lethal prostate cancer.

Example 10: Clinical Utility of a Genomic-Based Prognostic Test for Metastasis in High-Risk Post-Prostatectomy Patients Prostate cancer presents a significant population health burden in the United States. As the most frequently diagnosed cancer among men, almost 240,000 new cases are projected for 2013 (ACS, 2013). About half of these men will be treated with radical prostatectomy (RP) (Marciscano et al., 2012) and while many will achieve a durable cure, up to 50% will present with one or more adverse pathology features such as, seminal vesicle invasion (SVI), extracapsular extension (ECE) or positive surgical margins (Swanson et al., 2007, NCCN, 2013). Although these patients are considered by guidelines to be at an increased risk for disease progression, only a minority will develop metastatic disease and ultimately die of prostate cancer (Pound et al.). Further, while close monitoring with postoperative PSA testing can identify men at risk, the time to biochemical recurrence (BCR) after RP is not predictive for metastatic disease (Boorjian et al., 2011). And, while PSA doubling time (PSAdt) is a good surrogate, its accurate determination may not be possible in all patients as it requires precious time that the patient might not have (Freedland et al., 2007).

Treatment recommendations from National Comprehensive Cancer Network (NCCN) guidelines include radiation and/or hormone therapy or active surveillance (observation). These guidelines are based in part on results from three independent phase III randomized clinical trials that have demonstrated improvements in biochemical-free, metastasis-free and cancer-specific survival in high-risk post-RP men treated with radiation therapy (RT) (Bolla et al., 2005; Thompson et al., 2009; Wiegel et al., 2009). Despite this, deciding on appropriate use of radiation therapy post RP remains a challenging task. Knowledge that most clinically high-risk post-RP patients will never develop metastasis may be resulting in concern over inappropriate or over-utilization of secondary therapy in this population. Recognizing these factors, guidelines state that "predicting prognosis is essential for patient decision-making, treatment selection, and adjuvant therapy" (NCCN, 2013). Therefore, a need persists to more accurately characterize a patient's risk of metastasis following RP to guide treatment decisions.

Current assessment of risk used when considering post-operative secondary therapy is conducted based on individual clinicopathologic variables and/or through use of nomograms (Lughezzani et al, 2010). However, the ability to identify patients at substantially higher risk of metastasis and lethal prostate cancer on the basis of clinicopathologic features alone is limited. Therefore, the need is evident for novel risk prediction tools such as genomic information that reflect the true biological potential for tumor recurrence and spread. One such tool is a postoperative genomic classifier (GC) test as described in Example 3 that uses a whole-transcriptome microarray assay with formalin-fixed paraffin embedded prostate cancer specimens. Developed in collaboration with the Mayo Clinic, it was designed to predict early clinical metastasis following RP (Erho 2013). In a blinded clinical validation study of a contemporary high-risk population of post RP men with adverse pathology, the GC test was found to more accurately predict metastasis post-RP than clinical risk models (Davicioni, E. et al 2013).

In assessing a novel molecular test, experts have recommended that evidence be collected not only on the clinical validity of the test, but also on how use of the test influenced clinical practice management, a well-established measure of the test's clinical utility (Hornberger et al. Mole Gen, 2012, CDC, 2007). The primary objective of the study herein, was to determine how urologists' knowledge of results of the GC test influenced adjuvant and salvage treatment recommendations following RP.

Materials and Methods

This clinical utility study used a prospective, pre-post design, consisting of two independent sub-studies to assess patient cases at different points in patient management; both are collectively referred to herein as the DECIDE study (DECision-Impact DEcipher). In one study, urologist treatment recommendations were assessed in the adjuvant setting, following RP without any evidence of PSA rise or BCR. In the other, treatment recommendations were assessed for a different cohort of cases in the salvage setting, following RP with evidence of PSA rise or BCR. Urologists were invited to review a set of twelve cases and provide treatment recommendations for cases at each of the adjuvant and salvage time points. Urologists were presented de-identified clinical results from real patients involved in a previously conducted clinical validation study (Davicioni et al. 2013) and asked to provide treatment recommendations based solely on the clinical information provided (pre-GC). Then, results of the GC test were assessed for the same de-identified cases and urologists were asked again to provide treatment recommendations (post-GC). Twenty urologists participated in the adjuvant setting study and 15 in the salvage setting study.

The study was conducted in accordance with the Declaration of Helsinki and the Belmont report and was reviewed and approved by an independent IRB (Quorum Review Inc., Seattle, Wash.).

The primary objective of this study was to assess the effect of the GC test on urologists' adjuvant and salvage treatment recommendations for clinically and pathologically high-risk post-RP cases. Secondary objectives were to investigate specific changes in recommendation, proclivity of the GC result to result in more or less intensification of treatment, the relative importance of the GC to clinical variables and impact of the GC on urologist confidence with treatment recommendations. Protocol-defined eligibility criteria for participation in the study required US board certified urologists practicing for at least 3 years and performing a high volume of RPs annually (Table 25). All urologists participating in the study were fellowship trained, urologic oncologists. Potential participants were identified through conference delegate lists and through established networks of key opinion leaders and were assessed for eligibility using an available database. Email invites were sent to 50 urologists meeting the inclusion criteria. Enrollment packages were sent to eligible urologists interested in participating in the study and included a cover letter, an educational primer on the GC test, a confidentiality agreement and a web link to the study's informed consent form (ICF) and electronic case report questionnaires (eCRQ).

TABLE 25

| | Total<br>n = 21<br>No. (%) | Adjuvant<br>Evaluation<br>n = 20<br>No. (%) | Salvage<br>Evaluation<br>n = 15<br>No. (%) |
|---|---|---|---|
| Practice setting | | | |
| Tertiary Care | 13 (62%) | 12 (60%) | 9 (60%) |
| Community (hospital or private) | 8 (38%) | 8 (40%) | 6 (40%) |
| No. of years in practice | | | |
| Mean | 8.1 | 8.3 | 7.8 |
| Range | 3-25 | 3-25 | 3-25 |
| No. Radical Prostatectomy per year | | | |
| Mean | 184 | 179 | 200 |
| Range | 30-300 | 30-300 | 30-300 |
| Geographic region | | | |
| West/South Central | 4 (20%) | 4 (20%) | 3 (20%) |
| South East | 4 (20%) | 4 (20%) | 3 (20%) |
| Mid Atlantic | 4 (20%) | 3 (15%) | 2 (13%) |
| North East | 5 (25%) | 5 (25%) | 5 (33%) |
| North Central | 4 (20%) | 4 (20%) | 2 (13%) |

Twenty-four high-risk post-RP patient cases (12 adjuvant and 12 salvage) were selected for urologist review from the previously conducted clinical validation study. The number of patient cases was selected to provide enough cases to sufficiently evaluate urologist decision making across a range of high-risk patient types and was limited to twelve cases in each treatment setting so as to minimize study participant fatigue in reviewing patient cases. All cases were high-risk post-RP as defined by the presence of one or more adverse pathological features including (1) pathological Gleason score 8+ or Gleason score 7 with primary pattern 4; (2) pathological stage T3a (extracapsular extension) or T3b (seminal vesicle invasion); (3) positive surgical margins; or (4) Gleason grade upgrade from biopsy to surgery. Cases that did not experience a PSA nadir after RP were excluded from the study.

Cases were selected on the basis of their clinical risk factors and the GC predicted probability of developing metastatic disease at 5 and 3 years post-RP for the adjuvant and salvage treatment settings, respectively. In the adjuvant setting, six cases with concordant clinical risk features and GC risk and six cases with discordant predicted risk were selected. In the salvage setting, these numbers were 5 and 7, respectively. Clinical risk was determined based on the following clinicopathological variables: age at surgery, pre-operative PSA levels, pathologic stage, biopsy and pathologic Gleason score, presence or absence of SVI, presence or absence of ECE, surgical margin status and lymph node involvement (Table 26). Additionally, PSA doubling time (PSAdt) and time to BCR were provided for cases evaluated in the salvage setting. High (low) GC risk was defined as a 5- or 3-year predicted probability of metastasis greater (less) than 6% for the adjuvant setting and greater (less) than 18% for the salvage setting. The predicted probability was obtained from a prediction curve that uses Cox regression modeling to convert the oligonucleotide microarray 22-marker GC score into a patient probability of clinical metastasis at 5 years post RP. A function was created that translated GC scores into 5-year clinical metastasis event probabilities, and the resulting line of best fit was used for future predictions for novel patients. The curve allowed for the translation of a GC score (x-axis) into a patient's probability of clinical metastasis (y-axis) by visual inspection or by simple calculation. The threshold cut-off for the GC test of ≥6% was used to identify a patient at elevated risk for clinical metastasis above the average risk for other similar high-risk (e.g., patients with one or more adverse pathology features) or conversely at lower risk than the average risk of such patients for patients with Decipher test results<6%.

TABLE 26

| | Adjuvant<br>No. (N = 12) (%) | Salvage<br>No. (N = 12) (%) |
|---|---|---|
| Age (Years at RP or at BCR) | | |
| Median (Min, Max) | 60 (48, 70) | 66 (57, 74) |
| Pre-operative Prostate-specific Antigen | | |
| <10 ng/mL | 10 (83.3) | 9 (75) |
| 10-20 ng/mL | 1 (8.3) | 2 (16.7) |
| >20 ng/mL | 1 (8.3) | 0 |
| NA | 0 | 1 (8.3) |
| D'Amico risk groups | | |
| Low | 2 (16.7) | 1 (8.3) |
| Intermediate | 4 (33.3) | 7 (58.3) |
| High | 6 (50) | 4 (33.3) |
| Pathological Stage | | |
| pT2N0M0 | 6 (50) | 8 (66.7) |
| pT3N0M0 | 6 (50) | 4 (33.3) |
| Extra-capsular Extension | | |
| Present | 5 (41.7) | 3 (25) |
| Seminal Vesicle Invasion | | |
| Present | 4 (33.3) | 2 (16.7) |
| Surgical Margin Status | | |
| Positive | 8 (66.7) | 6 (50) |

TABLE 26-continued

|  | Adjuvant<br>No. (N = 12) (%) | Salvage<br>No. (N = 12) (%) |
|---|---|---|
| Pathological Gleason Score | | |
| 6 | 3 (25) | 0 |
| 7 (3 + 4) | 4 (33.3) | 2 (16.7) |
| 7 (4 + 3) | 1 (8.3) | 4 (33.3) |
| 8 | 1 (8.3) | 5 (41.7) |
| 9 | 2 (16.7) | 1 (8.3) |
| 10 | 1 (8.3) | 0 |
| Time to BCR (months) | | |
| Median (Min, Max) | NA | 16 (1, 112) |
| ≤36 months | NA | 9 (75) |
| >36 months | NA | 3 (25) |
| PSAdT | | |
| <6 months | NA | 5 (41.7) |
| ≥6 months | NA | 6 (50) |
| <9 months | NA | 9 (75) |
| ≥9 months | NA | 2 (16.7) |
| NA | NA | 1 (8.3) |

All cases were de-identified and presented in a randomized fashion to eliminate bias toward the urologist's pre- and post-GC treatment recommendations. Cases were randomized both from urologist to urologist and from pre to post-GC. Clinical variables and GC test results information were provided to urologists through a secure online platform, and all treatment recommendations were collected using the eCRQ. Treatment recommendations included referral to a radiation oncologist for radiation and/or initiation of hormones, close observation, or any other recommendation not listed on the eCRQ.

Confidence intervals for probability of recommendation change from pre- to post-GC were constructed using a normal approximation, a significance level of 5%, and all recommendations were considered as independent. Chi-squared tests were used for univariate assessment of treatment predictors and multivariable analyses were performed using logistic regression. All statistical analyses were performed using SAS 9.2 (Cary, N.C.). All tests were 2-sided with a Type I error probability of 5%.

Results

Participating physicians were all practicing, 'high-volume' urologists performing an average of 184 RPs per year (Table 25). Twenty-one urologists from 18 different institutions across the US participated: 20 in the adjuvant, and 15 in the salvage settings. Fourteen of these urologists completed assessment of cases in both sub-studies. Of the 21 urologists, 38% (n=8) practiced in a community-based hospital or private practice setting and 62% (n=13) practiced in tertiary care centers, the majority (85%) of which are National Cancer Institute (NCI) designated comprehensive cancer centers. Urologists had been practicing and performing surgery for 3 to 25 years (mean 8.1 years) and all had extensive experience managing and treating patients with prostate cancer both before and after RP.

Twelve patient cases were retrospectively selected for urologist review in each of the adjuvant and salvage settings (Table 26). Half of the adjuvant patient cases were preoperatively deemed low to intermediate risk according to D'Amico risk groups but were all subsequently up-graded/staged postoperatively. Furthermore, 75% of these cases presented with a pathologic Gleason score≥7, and 36% were ≥65 years of age at the time of surgery. For cases reviewed in the salvage setting, half had a time to BCR≤24 months, and 75% presented with a rapid PSAdt (<9 months). The majority (58%) of these cases were ≥65 years of age at the time of BCR.

Figure 41:
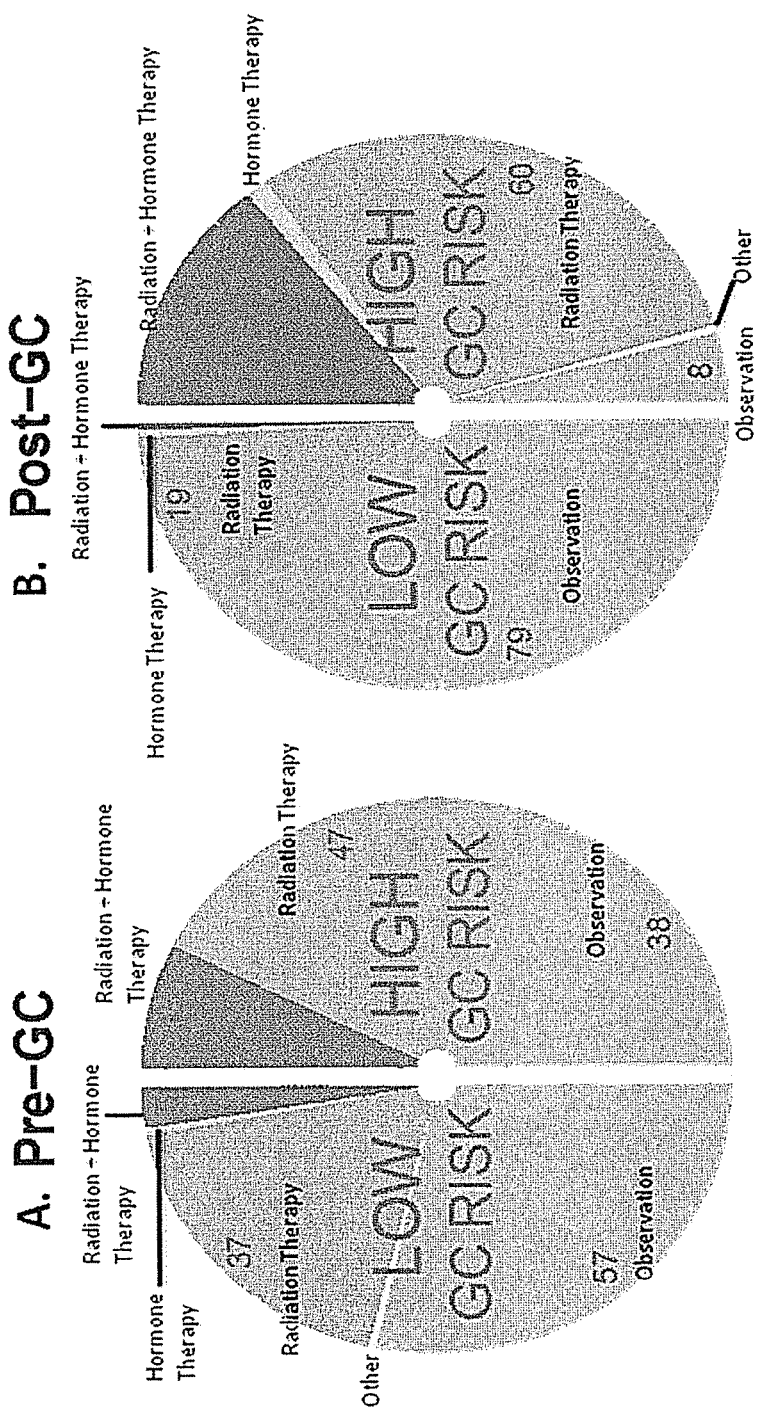
FIGS. 41A-B. Breakdown of treatment recommendations pre and post-GC for Low and High GC Risk groups in the Adjuvant setting. (A) pre-GC; (B) post-GC.

In the adjuvant treatment setting, 43% (95% CI: 37-49%) of recommendations changed following review of the GC test results (Table 27). Specifically, among case evaluations with a pre-GC recommendation involving treatment, 27% (95% CI: 19-35%) of recommendations were changed to observation post-GC. Notably, for case evaluations with a pre-GC recommendation of radiation alone (n=100), 31% (95% CI: 22-41%) changed to observation post-GC (Table 27). Among the case evaluations where observation was initially chosen (n=114), treatment was recommended for 37% of case evaluations post-GC, primarily in favor of radiation therapy (37/42). This can be visualized in FIG. 41, which shows how in comparison to pre-GC, post-GC urologist recommendations for observation or treatment (radiation and/or hormones) aligned to a high degree with the risk assigned by the GC test.

TABLE 27

| | | Adjuvant Treatment Recommendation | | | Salvage Treatment Recommendation | | |
|---|---|---|---|---|---|---|---|
| Pre-GC | Post-GC | N Pre-GC | Change N (%) | 95% CI | N Pre-GC | Change N (%) | 95% CI |
| Overall | Any Change | 240 | 103 (43%) | 37-49% | 180 | 95 (53%) | 45-60% |
| Observation | Any Treatment | 114 | 42 (37%) | 28-46% | 31 | 19 (61%) | 42-78% |
| | Radiation | 114 | 37 (32%) | 24-42% | 31 | 12 (39%) | 22-58% |
| | Hormone therapy | 114 | 4 (4%) | 1-9% | 31 | 0 (0%) | |
| | Radiation + Hormone therapy | 114 | 1 (0.9%) | 0-5% | 31 | 7 (23%) | 10-41% |
| | Other* | 114 | 1 (1%) | 0-5% | 31 | 2 (7%) | 0.8-21% |
| Any Treatment | Observation | 125 | 34 (27%) | 19-35% | 143 | 23 (16%) | 11-23% |
| Radiation | Observation | 100 | 31 (31%) | 22-41% | 82 | 11 (13%) | 7-23% |
| Hormone therapy | Observation | 1 | 1 (100%) | 3-100% | 6 | 1 (17%) | 0.4-64% |

TABLE 27-continued

|  |  | Adjuvant Treatment Recommendation | | | Salvage Treatment Recommendation | | |
|---|---|---|---|---|---|---|---|
| Pre-GC | Post-GC | N Pre-GC | Change N (%) | 95% CI | N Pre-GC | Change N (%) | 95% CI |
| Radiation + Hormone therapy | Observation | 24 | 2 (8%) | 1-27% | 55 | 11 (20%) | 10-33% |
| Other* | Observation | 1 | 1 (100%) | 3-100% | 6 | 0 (0%) | |

*In the advjuant setting, 'other' treatment recommendations included: "recheck path" and "medical oncologist and radiation oncoogist consult"
*In the salvage setting 'other' treatment recommendations included: "DRE, imaging" x3, "DRE, imaging, possible referral to radiation oncologist" x2, and "referral to medical oncologist"

Figure 43:
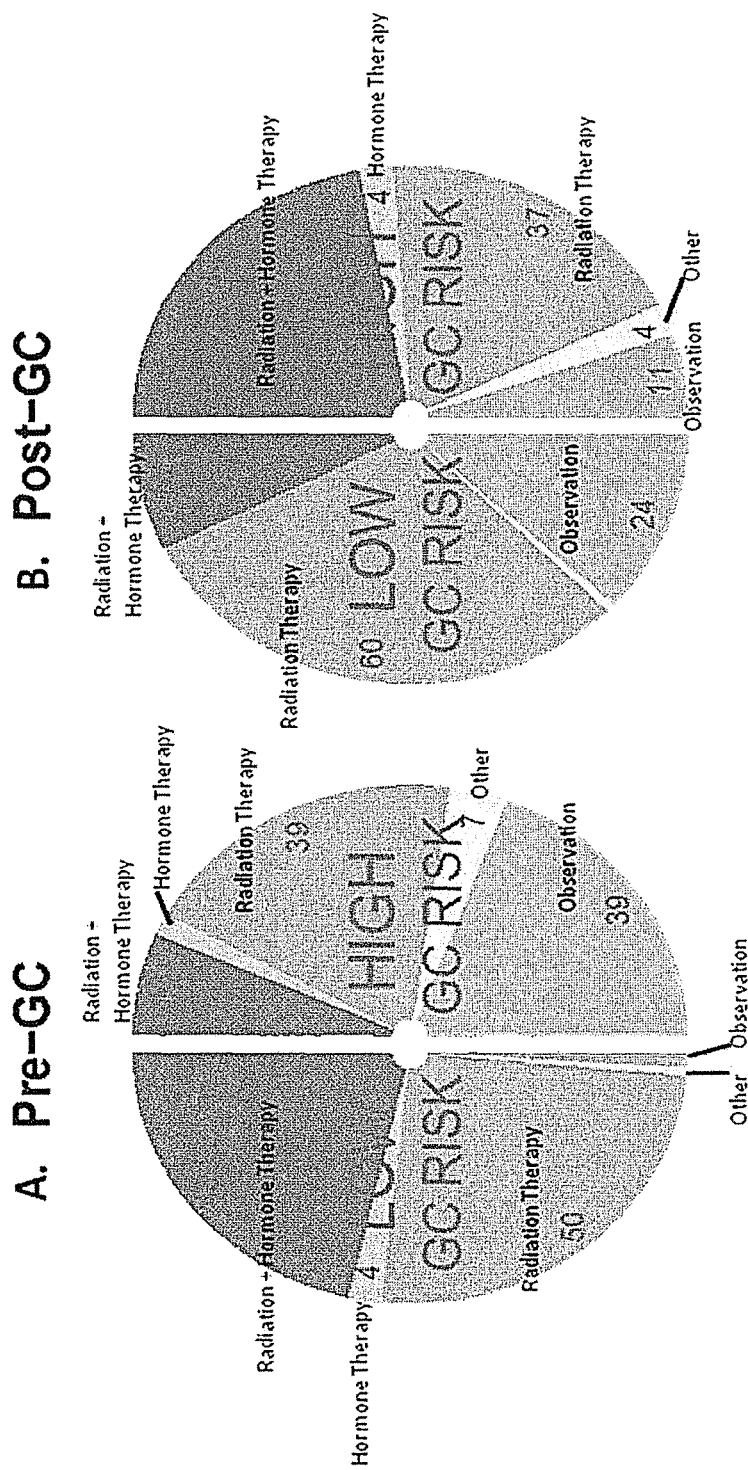
FIGS. 43A-B. Breakdown of treatment recommendations pre and post-GC for Low and High GC Risk groups in the Salvage setting. (A) pre-GC; (B) post-GC.

In the salvage setting, treatment recommendations changed 53% (95% CI: 45-60%) of the time (Table 27). Among case evaluations with a pre-GC recommendation involving treatment (n=143), 16% (95% CI: 11-23%) changed to observation post-GC. Expectedly, there were fewer pre-GC recommendations of observation (n=31) for case evaluations with BCR, 61% were recommended to change from observation to any treatment post-GC with radiation alone (n=12) or in combination with hormonal therapy (n=7) (Table 27). Similar to the analysis of the adjuvant setting above, we observed a trend that showed alignment of observation versus treatment recommendations with the GC score, even though treatment recommendation rates were higher overall in the salvage setting (FIG. 43). When accounting for intra-observer correlation, urologists' probability of changing recommendation was approximately normally distributed, with estimated probabilities of recommendation change of 43% (95% CI 36-50%) in the adjuvant setting and 53% (95% CI 39-67%) in the salvage setting. This indicated that no urologist is always changing or failing to change their recommendation from pre- to post-GC in either setting.

To further examine the impact of the relationships between clinicopathologic variables and the GC test results in urologist treatment recommendations, we evaluated the proportion of urologists recommending treatment pre- and post-GC over the complete set of case evaluations as well as within individual clinicopathologic variables for high and low GC risk patients (Table 29A-B). GC risk was established based on whether the predicted probability of developing metastasis was above (high GC risk) or below (low GC risk) the average risk for the original study population (see methods). Overall, in the adjuvant setting, treatment was recommended 52% of the time pre-GC. Upon reviewing the GC test results, those with a low GC risk were recommended treatment only 21% of the time compared to those with a high GC risk who were recommended treatment 90% of the time (p<0.0001). Similarly, in the salvage setting, the overall proportion of treatment recommendation was 79% pre-GC, but post-GC fell to 75% in the low GC risk group and rose to 85% in the high-risk GC group (p=0.031).

TABLE 29A

Table 29A. Adjuvant Setting

| | | Post-GC Recommendation N (row %) [95% CI] | | | | | | |
|---|---|---|---|---|---|---|---|---|
| | | Observe | Any Treatment | Radiation therapy | Radiation ± Hormone therapy | Hormone therapy | Other | Totals |
| Pre-GC Recommendation | Observe | 71 (62%) [52-71%] | 42 (37%) [28-46%] | 37 (32%) [24-42%] | 1 (0.9%) [0-5%] | 4 (4%) [1-9%] | 1 (1%) [0-5%] | 114 |
| | Any Treatment | 34 (27%) [19-35%] | 91 (73%) [64-806%] | NA | NA | 0 | 0 | 125 |
| | Radiation therapy | 31 (31%) [22-41%] | NA | 51 (51%) [41-61%] | 18 (18%) [11-27%] | 0 | 0 | 100 |
| | Radiation + Hormone Therapy | 2 (8%) [1-27%] | NA | 6 (25%) [10-47%] | 16 (67%) [45-84%] | 0 | 0 | 24 |
| | Hormone Therapy | 1 (100%) [3-100%] | NA | 0 | 0 | 0 | 0 | 1 |
| | Other* | 1 (100%) [3-100%] | 0 | 0 | 0 | 0 | 0 | 1 |
| | Totals | 106 | 133 | 94 | 35 | 4 | 1 | 240 |

Italicized and underlined region breaks out "Any Treatment" into the three available treatment options and are not included in row and column totals
*In the advjuant setting, 'other' treatment recommendations included: "recheck path" and "medical oncologist and radiation oncoogist consult"

TABLE 29b

Table 29B. Salvage Setting

Post-GC Recommendation

N (row %) [95% CI]

| | | Observe | Any Treatment | Radiation therapy | Radiation ± Hormone therapy | Hormone therapy | Other | Totals |
|---|---|---|---|---|---|---|---|---|
| Pre-GC Recommendation | Observe | 10 (32%) [17-51%] | 19(61%) [42-78%] | 12 (39%) [22-58%] | 7 (23%) [10-41%] | 0 | 2 (7%) [0.8-21%] | 31 |
| | Any Treatment | 23 (16%) [11-23%] | 118 (86%) [79-91%] | 78 (55%) [46-63%] | 37 (26%) [19-34%] | 3 (2%) [0.4-6%] | 2 (2%) [0.3-9%] | 143 |
| | Radiation | 11 (13) [7-23%] | 69 (84%) [74-91%] | 53 (65%) [53-75%] | 16 (20%) [12-30%] | 0 | 2 (2%) [0.3-9%] | 82 |
| | Radiation + Hormone Therapy | 11 (20%) [10-33%] | 44 (80%) [67-90%] | 23 (42%) [29-56%] | 20 (36%) [24-50%] | 1 (2%) [0-10%] | 0 | 55 |
| | Hormone Therapy | 1 (17%) [0.4-64%] | 5 (83%) [36-100%] | 2 (33%) [4-78%] | 1 (17%) [0.4-64%] | 2 (33%) [4.3-78%] | 0 | 6 |
| | Other* | 0 | 6 (100%) [54-100%] | 1 (17%) [0.4-64%] | 5 (83%) [36-100%] | 0 | 0 | 6 |
| | Totals | 33 | 143 | 91 | 49 | 3 | 4 | 180 |

Italicized and underlined region breaks out "Any Treatment" into the three available treatment options are not included in row and column totals
*In the salvage setting 'other' treatment recommendations included: "DRE, imaging" ×3, "DRE, imaging, possible referral to radiation oncologist" ×2, and "referral to medical oncologist"

Figure 42:
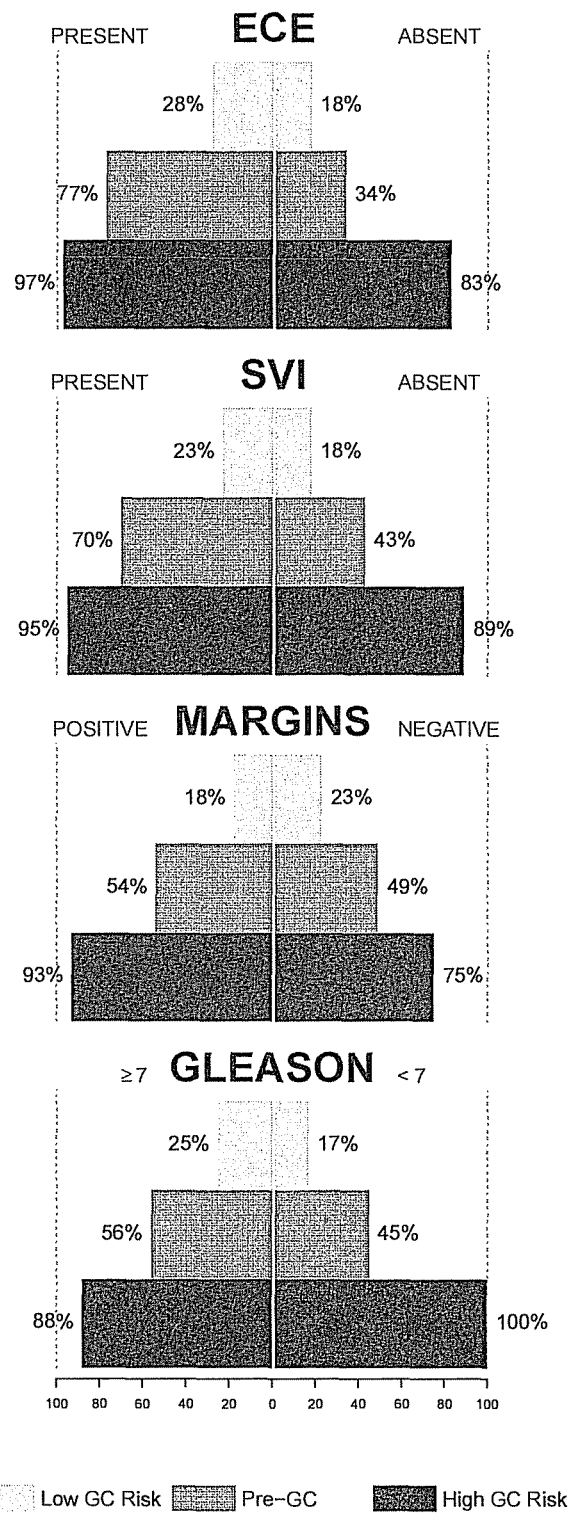
FIG. 42. Proportion of recommendations for treatment for the indicated values of clinical variables (eg: Presence/Absence) Pre-GC and the resulting proportion recommended for treatment post-GC in High and Low GC Risk groups in the Adjuvant setting.
Figure 44A:
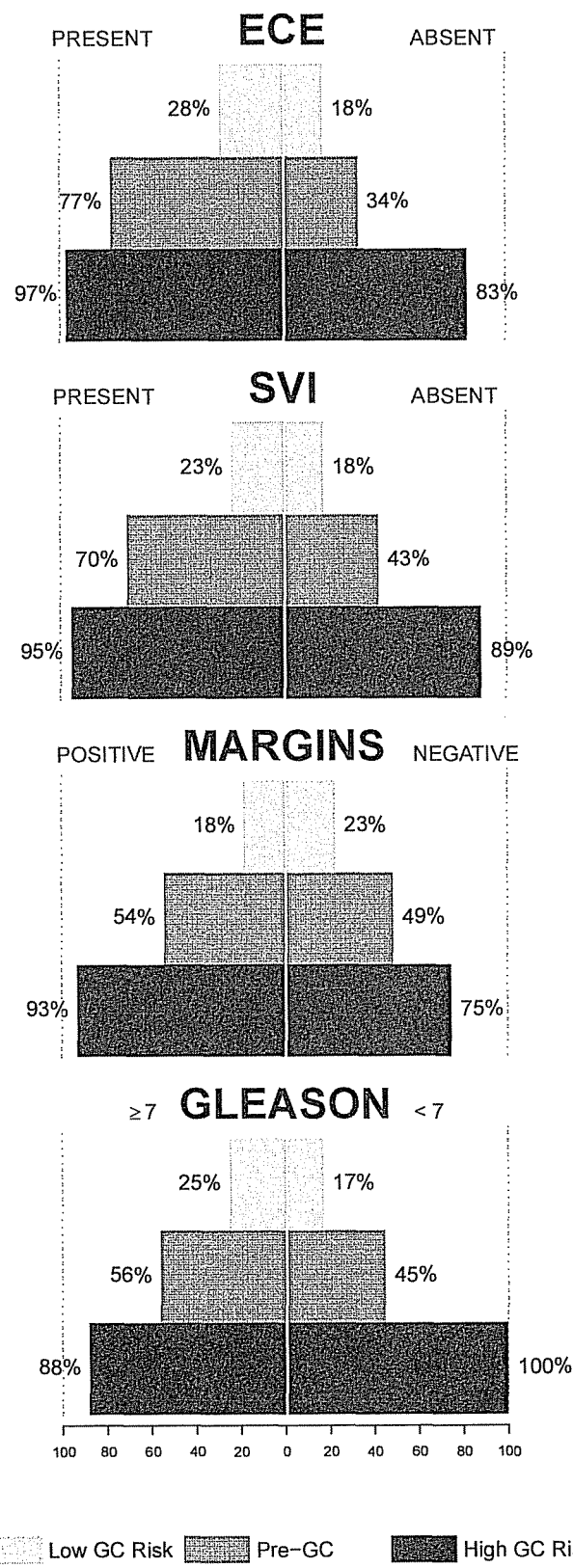
FIGS. 44A-B. Proportion of recommendations for treatment for the indicated values of clinical variables (eg: Presence/Absence) Pre-GC and the resulting proportion recommended for treatment post-GC in High and Low GC Risk groups in the Salvage setting.
Figure 44B:
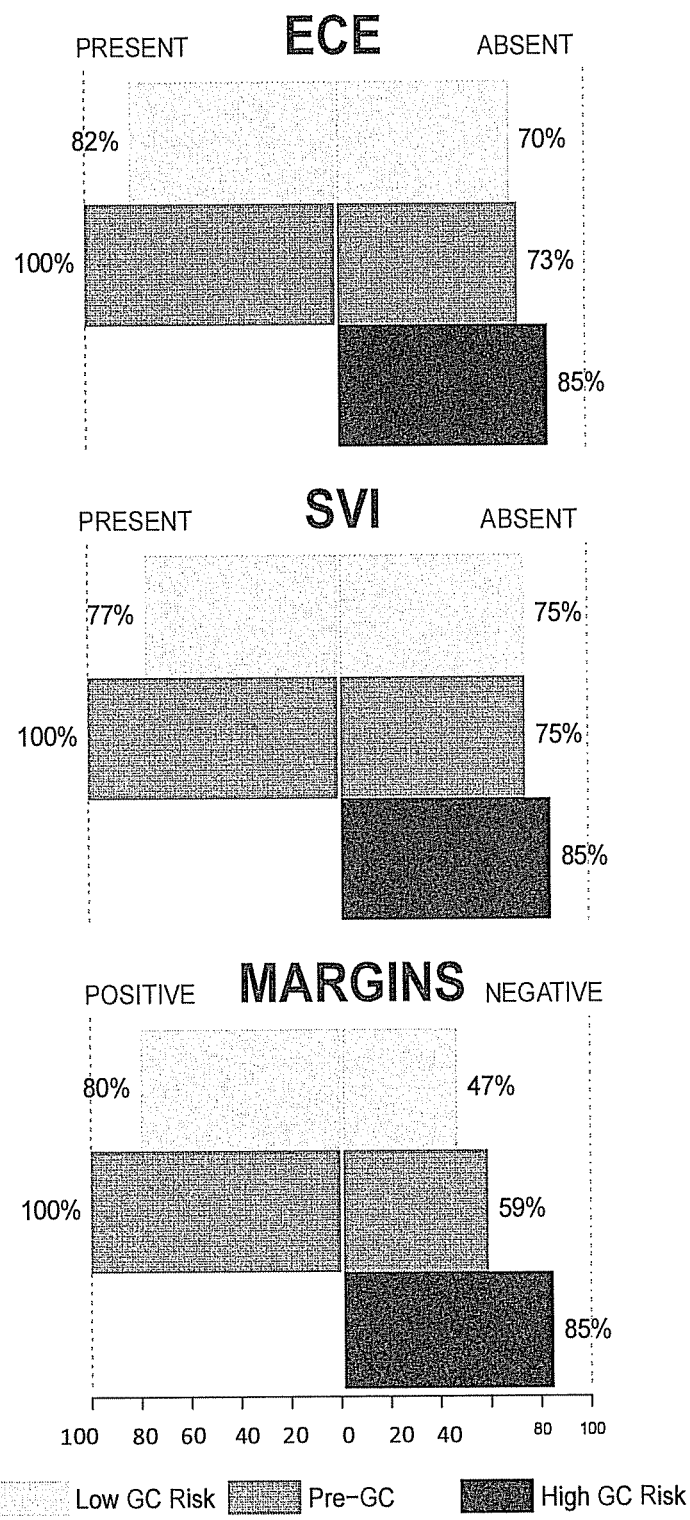

When evaluating individual clinical variables in the adjuvant setting (Table 30), patients with ECE represented the subgroup with the highest proportion of treatment recommendations pre-GC (77%); this fell to 28% for low GC risk case evaluations and rose to 97% for high GC risk case evaluations post-GC (p<0.0001) (FIG. 42). Similarly, in cases with positive surgical margins, 54% were recommended treatment pre-GC. Treatment recommendation dropped to 18% for cases with low GC risk and rose to 93% in high GC risk cases (p<0.0001). For cases with pathological Gleason score≥7 disease, 50% were recommended treatment pre-GC, among those with low GC risk only 25% were recommended treatment versus 88% of those cases with high GC risk (p<0.01). The largest magnitude in change was observed in cases with SVI. Pre-GC, 70% of SVI cases were recommended treatment, but this dropped to 42% of cases post-GC. Among those cases with low GC risk, only 23% were recommended treatment in the presence of SVI. Cases with high GC risk apparently were perceived by urologists to reinforce the high-risk SVI pathology and 95% were recommended for treatment (p<0.0001). These results reinforced the impact of the GC test and indicated that the proportion of treatment recommendation was more strongly associated with the GC risk (or probability of developing metastasis) than any of the clinical variables (Table 30). Evaluation of individual clinical variables in the salvage setting (Table 30), showed that differences in adverse pathology within ECE, SVI and margin status did not appear to influence treatment recommendations post-GC (FIG. 44). The main driver for treatment recommendations was PSAdt. As expected, cases with a rapid PSAdt of <6 months were recommended for treatment by 93% of urologists pre-GC. However, the proportion dropped to 73% within low GC risk patients post-GC. For cases with longer PSAdt (and hence a presumed better prognosis), only 14 recommendations for treatment were made pre-GC, but this increased to 25 post-GC and all of these cases had high GC risk. As observed for the adjuvant setting, within the salvage setting study, GC risk had a stronger impact on the recommendation to treat than most clinical variables (other than margin status).

TABLE 30

| | | | | Treatment Recommended Post-GC | | P-Value for Effect | P-values for Post-GC Treatment | |
|---|---|---|---|---|---|---|---|---|
| Time point | Variable | | Treatment Recommended Pre-GC | Low GC Risk | High GC Risk | of Clinical Variable Pre-GC | Effect of GC risk | Effect of clinical Variable |
| Adjuvant | Overall | | 125 (52.1%) | 25 (20.8%) | 108 (90%) | | <0.0001 | NA |
| | ECE | Absent | 48 (34.3%) | 14 (17.5%) | 50 (83.3%) | <0.0001 | <0.0001 | 0.16 |
| | | Present | 77 (77%) | 11 (27.5%) | 58 (96.7%) | | | |
| | SVI | Absent | 69 (43.1%) | 11 (18.3%) | 89 (89%) | <0.0001 | <0.0001 | 0.36 |
| | | Present | 56 (70%) | 14 (23.3%) | 19 (95%) | | | |

TABLE 30-continued

| Time point | Variable | | Treatment Recommended Pre-GC | Treatment Recommended Post-GC | | P-Value for Effect of Clinical Variable Pre-GC | P-values for Post-GC Treatment | |
|---|---|---|---|---|---|---|---|---|
| | | | | Low GC Risk | High GC Risk | | Effect of GC risk | Effect of clinical Variable |
| | Positive Margins | Absent | 39 (48.8%) | 14 (23.3%) | 15 (75%) | 0.49 | <0.0001 | 0.24 |
| | | Present | 86 (53.8%) | 11 (18.3%) | 93 (93%) | | | |
| | Gleason Upgrading | Downgrade | 40 (66.7%) | 9 (22.5%) | 20 (100%) | <0.0001 | | |
| | | No Change | 45 (37.5%) | 13 (21.7%) | 49 (81.7%) | | <0.0001 | 0.97 |
| | | Upgrade | 40 (66.7%) | 3 (15%) | 39 (97.5%) | | | |
| | Pathological Gleason | <7 | 36 (45%) | 10 (16.7%) | 20 (100%) | 0.046 | | |
| | | 7 | 50 (50%) | 15 (25%) | 35 (87.5%) | | 0.011 | 0.5 |
| | | >7 | 39 (65%) | | 53 (88.3%) | | | |
| Salvage | Overall | | 143 (79.4%) | 79 (75.2%) | 64 (85.3%) | | 0.031 | NA |
| | ECE | Absent | 98 (72.6%) | 42 (70%) | 64 (85.3%) | 0.0003 | 0.009 | 0.1 |
| | | Present | 45 (100%) | 37 (82.2%) | | | | |
| | SVI | Absent | 113 (75.3%) | 56 (74.7%) | 64 (85.3%) | 0.0051 | 0.03 | 0.62 |
| | | Present | 30 (100%) | 23 (76.7%) | | | | |
| | Positive Margins | Absent | 53 (58.9%) | 7 (46.7%) | 64 (85.3%) | <0.0001 | 0.0005 | 0.007 |
| | | Present | 90 (100%) | 72 (80%) | | | | |
| | Gleason Upgrading | No Change | 101 (74.8%) | 48 (80%) | 64 (85.3%) | 0.008 | 0.23 | 0.14 |
| | | Upgrade | 42 (93.3%) | 31 (68.9%) | | | | |
| | Pathological Gleason | 7 | 75 (83.3%) | 48 (80%) | 26 (86.7%) | 0.29 | 0.03 | 0.37 |
| | | >7 | 68 (75.6%) | 31 (68.9%) | 38 (84.4%) | | | |
| | BCR Time | <36 months | 123 (91.1%) | 79 (79.2%) | 27 (90.0%) | <0.0001 | 0.8 | 0.11 |
| | | ≥36 months | 20 (44.4%) | | 37 (82.2%) | | | |
| | PSAdt | <6 months | 70 (93.3%) | 44 (73.3%) | 14 (93.3%) | 0.007 | 0.058 | 0.72 |
| | | ≥6 months | 67 (74.4%) | 35 (77.8%) | 38 (84.4%) | | | |
| | | <9 months | 123 (91.1%) | 79 (75.2%) | 27 (90%) | <0.0001 | 0.11 | 0.93 |
| | | ≥9 months | 14 (46.7%) | | 25 (83.3%) | | | |

Low (High) GC Risk at Adyjuvant timepoint = 5 year predicted probability <6% (>6%)
Low (High) GC Risk at Salvage timepoint = 3 year predicted probability <18% (>18%)

Figure 45:
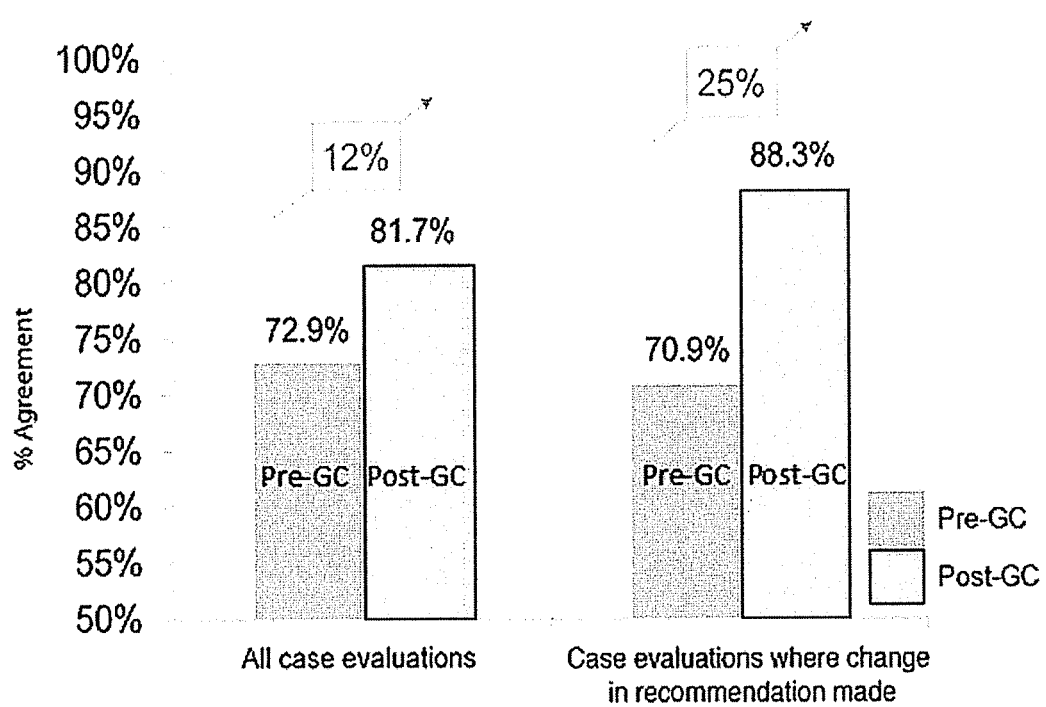
FIG. 45. Urologists confidence in treatment recommendations made post GC test results.

To measure recommended changes in treatment intensity, we established a baseline clinical perception of risk (hereafter referred to as perceived risk). Cases were considered low perceived risk if less than half of urologists recommended treatment and high perceived risk if more than half recommended treatment in the absence of the GC test results. In the adjuvant and salvage settings we observed that if perceived risk was high but GC risk was low, then, respectively, 50% and 46% of recommendations reduced treatment intensity post-GC (e.g., radiation to observation or radiation/hormone combination to radiation only) (Table 28). Very few recommendations were made that increased treatment intensity, (only 5% and 3.8%, respectively for adjuvant and salvage treatment recommendations). Conversely, for cases with an initial low perceived risk but high GC risk, we observed a 55% and 58% increase in treatment intensity in both the adjuvant and salvage settings, respectively. Influence of GC risk on change in intensity for all clinical risk categories and treatment settings were highly statistically significant (<0.0001). Furthermore, a multivariable model adjusting for the pre-GC clinical risk showed that GC risk influenced change in treatment recommendation intensity (p<0.0001). To understand the extent to which the GC test result impacts confidence in making a treatment recommendation, urologists were asked to report on the degree to which they felt confident in the treatment recommendation made for case evaluations both pre- and post-GC, as well as the extent to which they felt the GC test result influenced those treatment recommendations. Results showed that for case evaluations where a treatment recommendation was made, urologist confidence in treatment recommendations increased by 25% and 23% in the adjuvant and salvage settings, respectively. Additionally, urologists reported that the GC test result influenced their treatment recommendation in 83.5% (adjuvant) and 87.4% (salvage) of case evaluations (Table 31). As shown in FIG. 45, urologists report increased confidence in treatment recommendations made post GC test results. Table 32 shows five de-identified patients from the cohort used in this study, their clinical characteristics, the predicted probability at five years based on GC test and the actual clinical outcome observed. As seen there, Low predicted probabilities by GC test correspond with no evidence of disease, whereas high predicted probability corresponds with metastatic disease.

TABLE 28

| Timepoint | Perceived Risk | GC Risk | Decrease | No Change | Increase |
|---|---|---|---|---|---|
| Adjuvant | high | low | 20 (50%) | 18 (45%) | 2 (5%) |
|  |  | high | 3 (5%) | 35 (58.3%) | 22 (36.7%) |
|  | low | low | 15 (18.8%) | 60 (75%) | 5 (6.3%) |
|  |  | high | 3 (5%) | 24 (40%) | 33 (55%) |
| Salvage | high | low | 48 (45.7%) | 53 (50.5%) | 4 (3.8%) |
|  |  | high | 1 (3.3%) | 17 (56.7%) | 12 (40%) |
|  | low | high | 4 (8.9%) | 15 (33.3%) | 26 (57.8%) |

Low (High) Perceived Risk = <half (>half) of clinicians initially recommend treatment
Low (High) GC Risk at Advjuvant timepoint = 5 year predicted probability <6% (>6%)
Low (High) GC Risk at Salvage timepoint = 3 year predicted probability <18% (>18%)

TABLE 31

|  | All | | Recommendation Changed | |
|---|---|---|---|---|
|  | Pre-GC Test | Post-GC Test | Pre-GC Test | Post-GC Test |
| Adjuvant Confidence in treatment recommendation | | | | |
| Agree | 72.9% | 81.7% | 70.9% | 88.3% |
| Disagree | 3.8% | 5.8% | 4.9% | 2.9% |
| Neutral | 23.3.% | 12.5% | 24.3% | 8.7% |
| GC test influenced treatment recommendation | | | | |
| Agree | NA | 62.5% | NA | 83.5% |
| Disagree | NA | 8.3% | NA | 2.9% |
| Neutral | NA | 29.2% | NA | 13.6% |
| Salvage Confidence in treatment recommendation | | | | |
| Agree | 72.8% | 82.2% | 68.4% | 84.2% |
| Disagree | 4.4% | 2.8% | 5.3% | 2.1% |
| Neutral | 22.8% | 15.0% | 26.3% | 13.7% |
| GC test influenced treatment recommendation | | | | |
| Agree | NA | 68.3% | NA | 87.4% |
| Disagree | NA | 11.1% | NA | 4.2% |
| Neutral | NA | 20.6% | NA | 8.4% |

Agreement with confidence in treatment recommendation was assessed on a 5 point Likert scale where 3 was considered neutral

TABLE 32

|  | Age | pPSA | ECE | SVI | SM | Gleason | Nomogram* | Predicted prob of mets at 5 years | Actual outcome** |
|---|---|---|---|---|---|---|---|---|---|
| A | 58 | 194 | + | + | + | 3 + 4 | High | Low (5%) | NED |
| B | 60 | 22 | + | − | + | 4 + 3 | High | Low (4%) | NED |
| C | 46 | 11 | − | − | + | 3 + 4 | Int | Low (2%) | NED |
| D | 54 | 10 | + | − | + | 3 + 4 | Int | High (44%) | MET |
| E | 61 | 5 | − | − | − | 4 + 4 | Low | High (55%) | MET |

Note:
All of these patients were conservatively managed and did not receive any treatment post-RP
*UCSF CAPRA-S
**NED = No evidence of disease; MET = metastatic disease

DISCUSSION

This clinical utility study was designed to prospectively assess the effect of a genomic classifier (GC) test that predicts metastasis following RP on urologists' adjuvant and salvage treatment recommendations. The performance of the GC test was previously reported in a blinded, independent validation study of a population of 1,010 men at high risk of recurrence (based on adverse pathology) post RP. That study revealed that 60% of clinically high-risk patients would be reclassified as low risk with a cumulative incidence of metastasis of only 2.4% at 5 years post RP. Conversely, patients with the highest GC scores (19% of the population) had nearly 10 times higher cumulative incidence of metastasis by 5 years. Findings from this current study demonstrated that knowledge of the GC test result frequently impacted urologists' treatment recommendations in both the adjuvant (43%) and salvage settings (53%). Furthermore, we were able to show that for patients with low GC risk, while pre-GC urologists recommended treatment 43% of the time, post-GC they were recommended to observation 79% of the time. Taken together, the clinical validation and utility results implied that among the population of prostate cancer patients at high-risk of recurrence following RP, the majority of patients tested post GC will be recommended to close observation.

Guidelines on evidence development for molecular tests drafted in the past 3-5 years have urged going beyond obtaining evidence on assay analytical and clinical validity, encouraging additional research on how a test influences clinical practice management. To date in this nascent field, the number of published studies is fairly limited, but growing. In a clinical study of a molecular assay for stage II colon cancer, Srivastava et al. found that physicians changed chemotherapy decisions in 45% of patients, which fully validated predictions from a simulation of changes in NCCN guideline-directed treatment. One of the most studied areas of practice management change in molecular medicine has been risk prediction in breast cancer. In a comprehensive and systematic review of clinical validity and changes in clinical practice patterns, Hornberger et al. found 15 studies reporting on 5 different tests. They found chemotherapy recommendation changed between <1%-13% as reported in 4 studies of an online clinical decision support tool, compared with a median change across all studies of less than 35% in recommendations for a multi-gene assay. In comparison with these examples of accepted oncology tests, the finding in our study of a 43-53% change in recommendation upon receipt of the test results is supportive evidence that the GC test provides additional useful clinical information to guide therapy selection.

This study revealed relevant findings relating to current practice patterns for high-risk patients post-RP and confirmed urologist proclivity for not only increased salvage treatment at the point of BCR but also increased intensification of treatment when compared to the adjuvant setting. Overall, urologists' recommended treatment over 1.5 times as often in the salvage versus the adjuvant setting; treatment recommendations were made for 79% of case evaluations pre-GC in the salvage setting, 39% of which involved a recommendation for multi-modal (e.g., radiation and hormone) therapy. This compares to a recommendation for multi-modal therapy in only 19% of case evaluations pre-GC in the adjuvant setting. In addition, the findings imply a potential to over-treat in the salvage setting as evidence suggested that even in patients presenting with BCR, less than one-third will go on to develop metastasis. This is not without consequences for the patient as both postoperative radiation and hormone therapy incur with considerable morbidities including urinary incontinence and impotence, which can affect long-term patient quality of life.

Results from this study also confirmed that urologist decision-making in the adjuvant setting was mainly focused on whether or not to recommend postoperative radiation therapy. Prior to presentation of the GC test results, urologists recommended treatment in 52% of case evaluations with 99% of those recommendations including radiation therapy and only 20% of recommendations including hormone therapy. Accurate direction of radiation therapy to patients who are at highest biological risk for developing metastasis is critical as the morbidities and costs associated with treating patients with radiation modalities such as IMRT run high. Furthermore, we observed that the GC risk significantly influenced the treatment recommendations irrespective of the presence or absence of specific clinicopathogic features. Additionally, these findings suggested that in the salvage setting, the sensitivity of PSA rise may motivate urologists to recommend treatment despite its poor specificity. This hinted towards a role for the GC test to improve urologist decision-making in this setting. Similar results were found relating to the intensification of treatment, where changes in intensity were driven primarily by GC risk rather than the perceived risk. This suggested that given the information from the GC test, presumably measuring the true biological potential of a patient's tumor, urologists are more willing to commit to the intensification of therapy than if this recommendation were solely based on rising PSA and clinicopathologic variables (e.g., pre-GC).

Treatment recommendations changed in 43% of adjuvant setting case evaluations and 53% of salvage setting case evaluations. These findings demonstrated that knowledge of the genomic biomarker information in this GC test frequently influences these urologists' judgments about appropriate treatment in both the adjuvant and salvage settings.

Conclusion:

The DECIDE study assessed the effect of the GC test on urologist treatment recommendations for high-risk case evaluations in the adjuvant and salvage treatment settings. Findings demonstrated that knowledge of the GC test result frequently impacted urologists' treatment recommendations in both the adjuvant and salvage settings. Furthermore, the GC test appeared to better direct urologist treatment recommendations irrespective of the presence or absence of conventional pathology and clinical variables that are currently used to assess risk in these patients.

In conclusion, this study suggested that when implemented into routine clinical practice, the GC test had the potential to change treatment recommendations after radical prostatectomy and better identify patients that may benefit from intensive multimodal therapy, while sparing those who can be closely observed without initiating aggressive secondary therapy.

Example 11: Validation of a Genomic Classifier that Predicts Metastatic Disease Progression in Men with Biochemical Recurrence Post Radical Prostatectomy Roughly 50,000 men per year will present with biochemical recurrence (BCR) following local treatment for prostate cancer. These men, with rising PSAs as the lone indicator of recurrence, present a management dilemma due to their varied outcomes. While the post-radical prostatectomy (RP) recurrence group of patients is highly enriched for those who will develop lethal disease, many of these patients will experience BCR without developing subsequent metastases. Thus, there is a clear need to improve patient risk stratification in this context. Here, we evaluated a genomic classifier (GC, see Example 3) in men with BCR for its ability to predict clinical metastasis (e.g. positive bone or CT scans).

Methods

Patient Cohort

The aim of this study was to determine whether molecular features of primary prostate tumor specimens could aid in the prediction of outcomes at the time of BCR. Accordingly, we selected 110 Caucasian patients from a high risk cohort of over 1,000 men who experienced BCR following radical prostatectomy and for whom tissue was available (see Example 1). Only men with adenocarcinoma at the time of radical prostatectomy were included. Following prostatectomy, men were typically followed by a PSA measurement every 3 months for the first year, every 6 months for the second year and then annually thereafter. Biochemical recurrence was defined as a PSA>0.2 ng/ml with a subsequent confirmatory value. At the time of biochemical recurrence, men were restaged with a CT or MRI as well as a bone scan which were then performed on a yearly basis. Time to biochemical recurrence was defined as the time from radical prostatectomy to first detectable PSA>0.2 ng/ml. Metastasis was defined as a positive bone scan or visceral or extra-pelvic nodal metastasis seen on CT scan. Men who experienced BCR less than 6 months or had missing clinicopathologic variables were excluded from the analyses (n=85). Men who experienced metastasis following biochemical recurrence were designated as "Mets" and men without metastasis after biochemical recurrence were designated as "No-Mets". Adjuvant setting was defined as any treatment within 90 days after surgery. Salvage therapy was defined as any treatment after 90 days. Patient tumor and treatment characteristics are detailed in Table 33.

TABLE 33

| Patients Characteristics | Total n (row %) | Mets n (row %) | Mets-Free n (row %) | P-value* |
|---|---|---|---|---|
| Study Cohort | 85 | 51(60) | 34(40) | |
| Age | | | | 0.822 |
| 46-60 | 35 | 21(60) | 14(40) | |
| 61-74 | 50 | 30(60) | 20(40) | |
| Pathological Stage | | | | 0.026 |
| pT2N0M0 | 22 | 8(36) | 14(64) | |
| pT3/4N0M0 | 46 | 30(65) | 16(35) | |
| pTanyN + M0 | 17 | 13(76) | 4(24) | |
| Pathological Gleason Score (path GS) | | | | 0.034 |
| ≤6 | 4 | 0 (0.0) | 4(100.0) | |
| 7 | 44 | 23(52) | 21(48) | |
| ≥8 | 27 | 18(67) | 9(33) | |
| Pre-operative Prostate-specific Antigen (pre-op PSA) | | | | 0.362 |
| <10 ng/mL | 38 | 22(58) | 16(42) | |
| 10-20 ng/mL | 28 | 15(54) | 13(46) | |
| >20 ng/mL | 19 | 14(74) | 5(26) | |
| Seminal Vesicle Invasion (SVI) | 38 | 29(76) | 9(24) | 0.011 |
| Positive Surgical Margin (SM+) | 50 | 29(58) | 21(42) | 0.822 |
| Extra-capsular Extension (ECE) | 50 | 36(72) | 14(28) | 0.013 |
| Prostate Cancer-specific Mortality | 22 | 22(100) | 0(0) | — |
| Adjuvant Radiation Therapy | 11 | 8(72) | 3(27) | 0.552 |
| Adjuvant Androgen Deprivation Therapy | 37 | 29(78) | 8(22) | 0.005 |
| Salvage Radiation Therapy | 41 | 25(61) | 16(39) | 0.965 |
| Salvage Androgen Deprivation Therapy | 57 | 44(77) | 13(23) | <0.001 |
| Time to BCR | | | | 0.19 |
| ≤2 years | 51 | 34(67) | 17(33) | |
| >2 years | 34 | 17(50) | 17(50) | |
| PSAdT (NA = 12) | | | | 0.006 |
| ≤9 months | 48 | 33(68) | 15(31) | |
| >9 months | 25 | 8(32) | 17(68) | |

*Pearson's chi-squared or Fisher Exact Test

Specimen Selection and Processing

Following histopathological review, formalin-fixed paraffin embedded (FFPE) prostatic adenocarcinoma tissues from the primary tumor at the time of prostatectomy were macrodissected. Total RNA was then extracted and purified using RNeasy FFPE nucleic acid extraction kit (Qiagen Inc., Valencia, Calif.), and subjected to whole-transcriptome amplification using the WT-Ovation FFPE system (NuGen, San Carlos, Calif.). Amplified products were fragmented, labeled, and hybridized to Human Exon 1.0 ST GeneChips (Affymetrix, Santa Clara, Calif.) that profile coding and non-coding regions of the transcriptome using approximately 1.4 million probe selection regions, each representing a genomic biomarker or feature. Following microarray quality control using the Affymetrix Power Tools packages, probeset summarization and normalization was performed by frozen robust multi-array analysis, which is available through Bioconductor. Human Exon GeneChip files corresponding to these cases are available from the National Center for Biotechnology Information's Gene Expression Omnibus database.

Calculation of GC Scores, PSADT and Nomogram Scores

Previously we described a validated 22-marker genomic classifier (GC) (see Example 3). Here we employed the same GC, with GC scores outputted as a value between 0 and 1. Depending on the analysis, GC score were treated as a categorical or continuous variable. Graphical diagnostic, receiver operating characteristic (ROC)-based methods on the training dataset was used to estimate an optimal cut-off for GC score. PSADT a measure of how fast the PSA levels doubles was calculated by natural log of 2 divided by slope of linear regression line of log 2 of PSA measures over time. CAPRA-S scores were calculated as described in Cooperberg et al. (Cooperberg Cancer 2011), and Stephenson 5 year probability of survival were calculated using nomogram described in Stephenson et al.

Statistical Analyses

All statistical analyses were performed in R v2.14.1. All tests were two-sided with a type I error probability of 5%. GC was compared to standard clinicopathologic variables, PSADT, time to BCR, clinical-only classifiers (CC, CAPRA-S scores and Stephenson's nomogram) and the integrated clinical and genomic classifier (GCC) for predicting metastatic disease. The concordance summary index (extension of c-index), an extension of area under the ROC curve (AUC) for censored data was used to compare classifier performance to predict metastasis. For the survival ROC function, the nearest-neighbour estimator was used with λ=0.002 to approximate survival function density. Calibration plots were used to assess the agreement between observed and predicted outcomes. Decision curve analysis was used to assess the net increase/decrease in the proportion of necessary/unnecessary treated patients. Survival ROC and decision curves were evaluated for prediction of metastasis within 3 years post-BCR.

Cox Proportional Hazard Regression model for case-cohort design was used to evaluate the prognostic value and significance of GC and clinicopathologic risk factors in predicting the development of metastasis after BCR. Proportional hazards assumptions of the Cox model were confirmed by evaluating the scaled Schoenfeld residuals. GC was used as a continuous variable (step size=0.1); pathological Gleason score was dichotomized into <8 and ≥8 considering the small number of patients who had the score of 6 and below; pre-operative PSA values were log transformed due to their skewed distribution; SVI, SM, extracapsular extension (ECE) were used as binary variables. In the Cox model, the estimated risks were adjusted for the administration of adjuvant hormone therapy. Cumulative incidence curves were constructed using Fine-Gray competing risks analysis to estimate the risk of failure due to prostate cancer only, after removing other type of failures (e.g. other reason for death). Time-dependent analyses were performed by weighting patients without the event as suggested by Barlow.

Results

Characteristics of men in our cohort who experienced BCR following RP are detailed in Table 33. Median time to BCR was 14.60 months (range 1.1-85.33). Men experiencing metastasis following BCR ("mets") did so with a median time of 37.16 months (range 3.15-111.54). These men had higher pathological grade and stage at prostatectomy, higher pre-operative PSAs, a more rapid time to BCR and more rapid PSAdTs (Table 33). They were also more likely to receive adjuvant and salvage therapies (Table 33).

Figure 46:
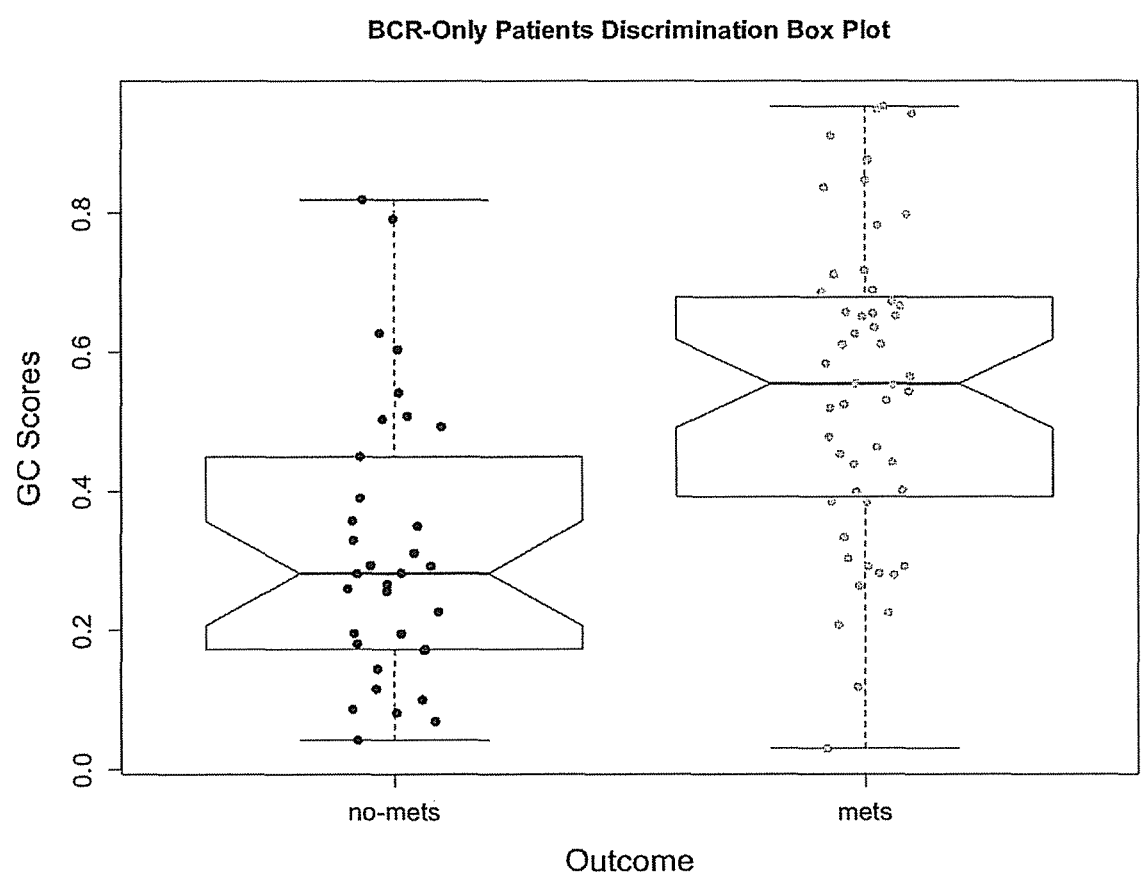
FIG. 46. GC Score distribution among METS (right—light grey circles) and No-METS patients (left—dark grey circles).
Figure 47:
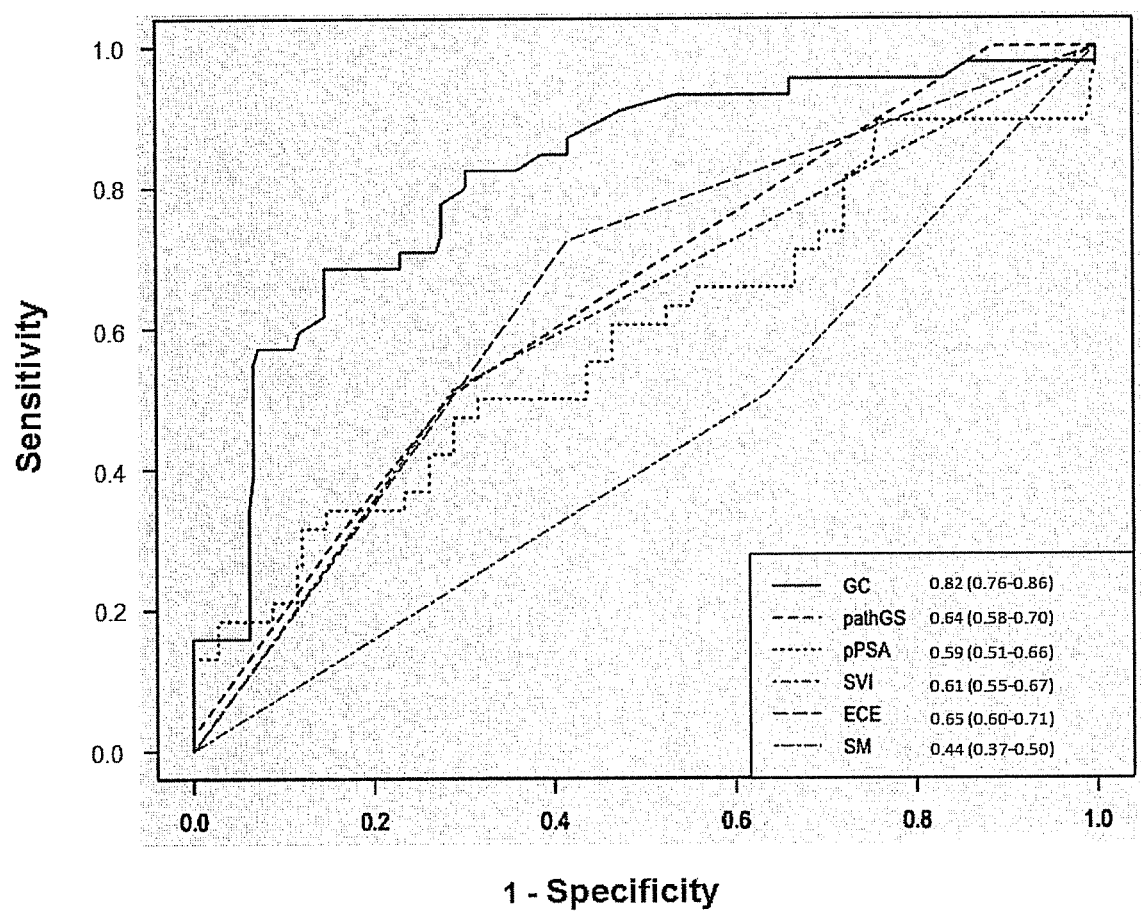
FIG. 47. 3-year Survival ROC comparing GC and clinicopathologic features. Values within legend indicate AUC and its corresponding 95% Confidence Interval.
Figure 48:
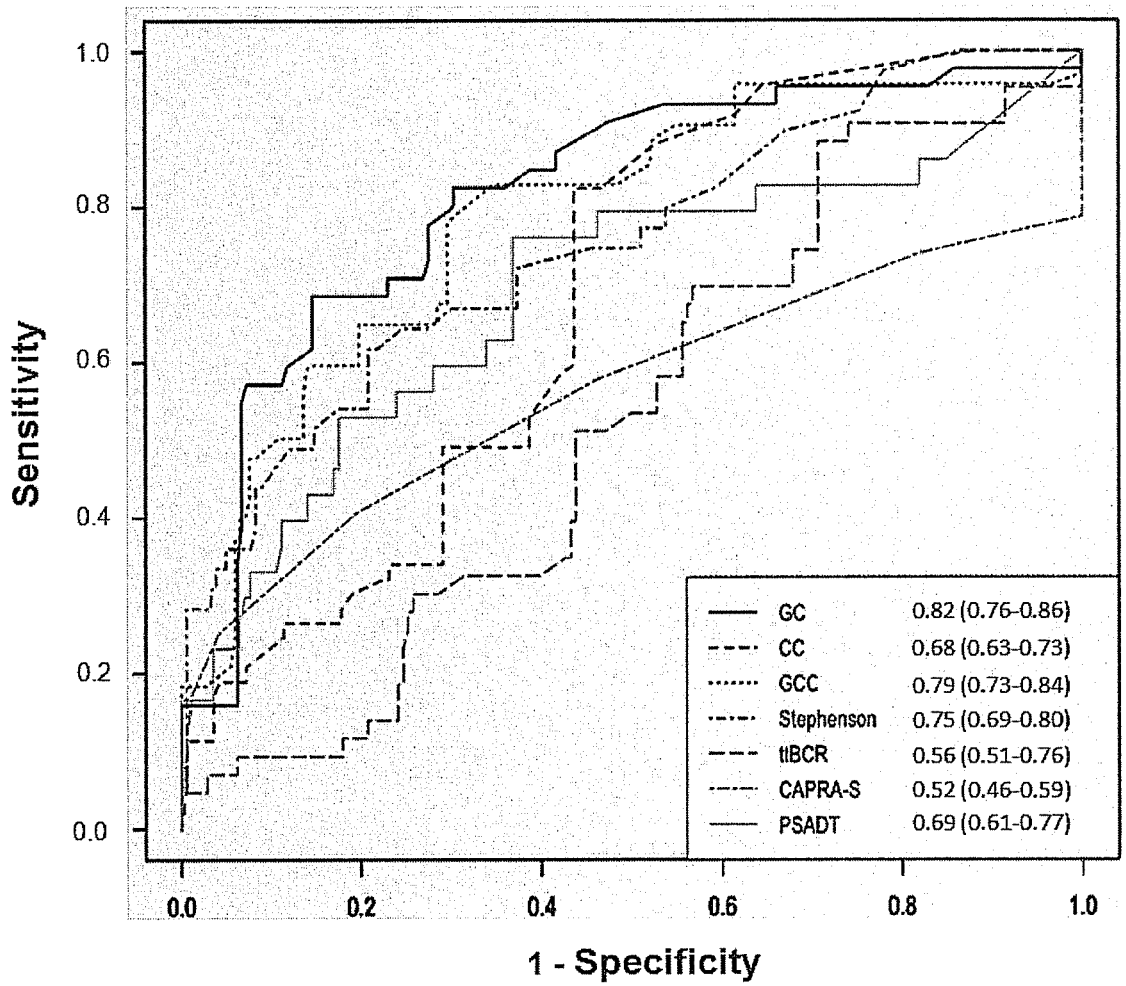
FIG. 48. 3-year Survival ROC of clinical-only and genomic-based models. Values within legend indicate AUC and its corresponding 95% Confidence.
Figure 49:
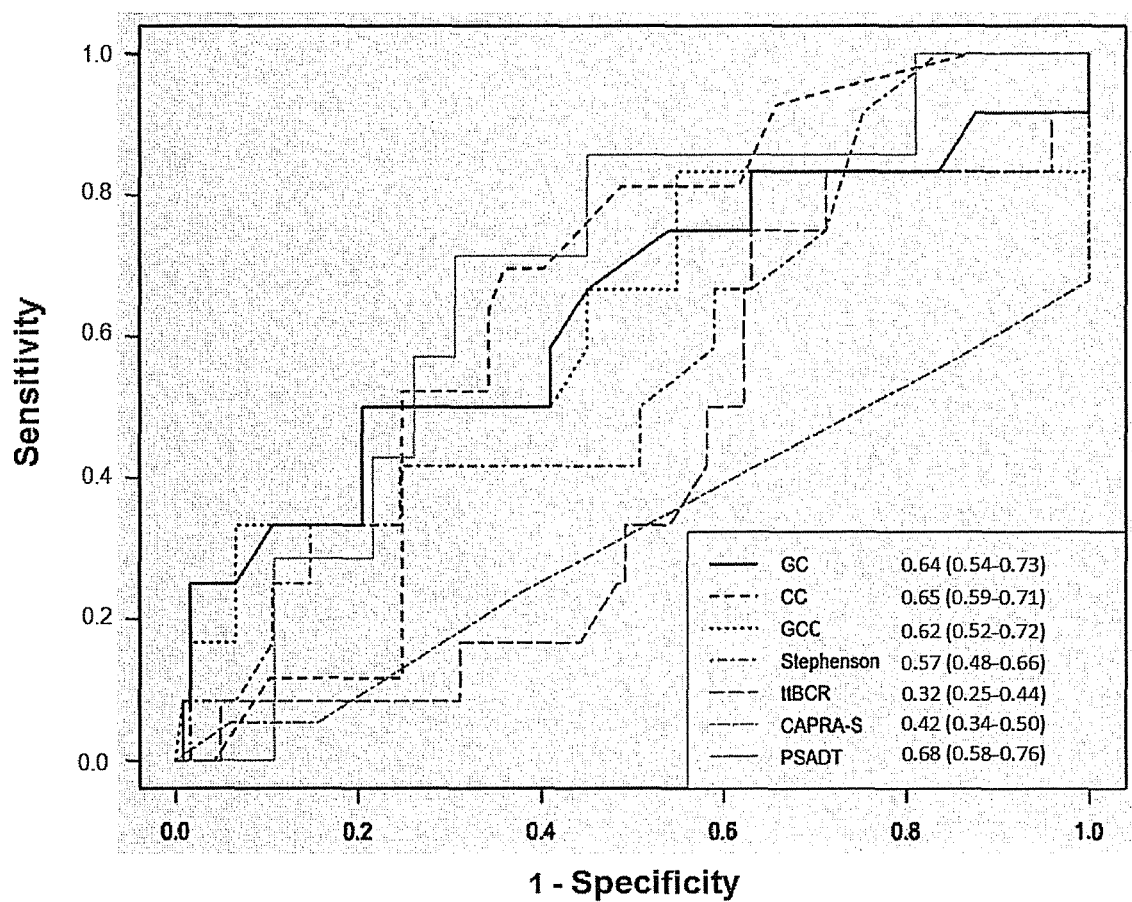
FIG. 49. 3-year Survival ROC of clinical-only and genomic-based models after excluding patients with Adjuvant therapy. Values within legend indicate AUC and its corresponding 95% Confidence Interval.
Figure 50:
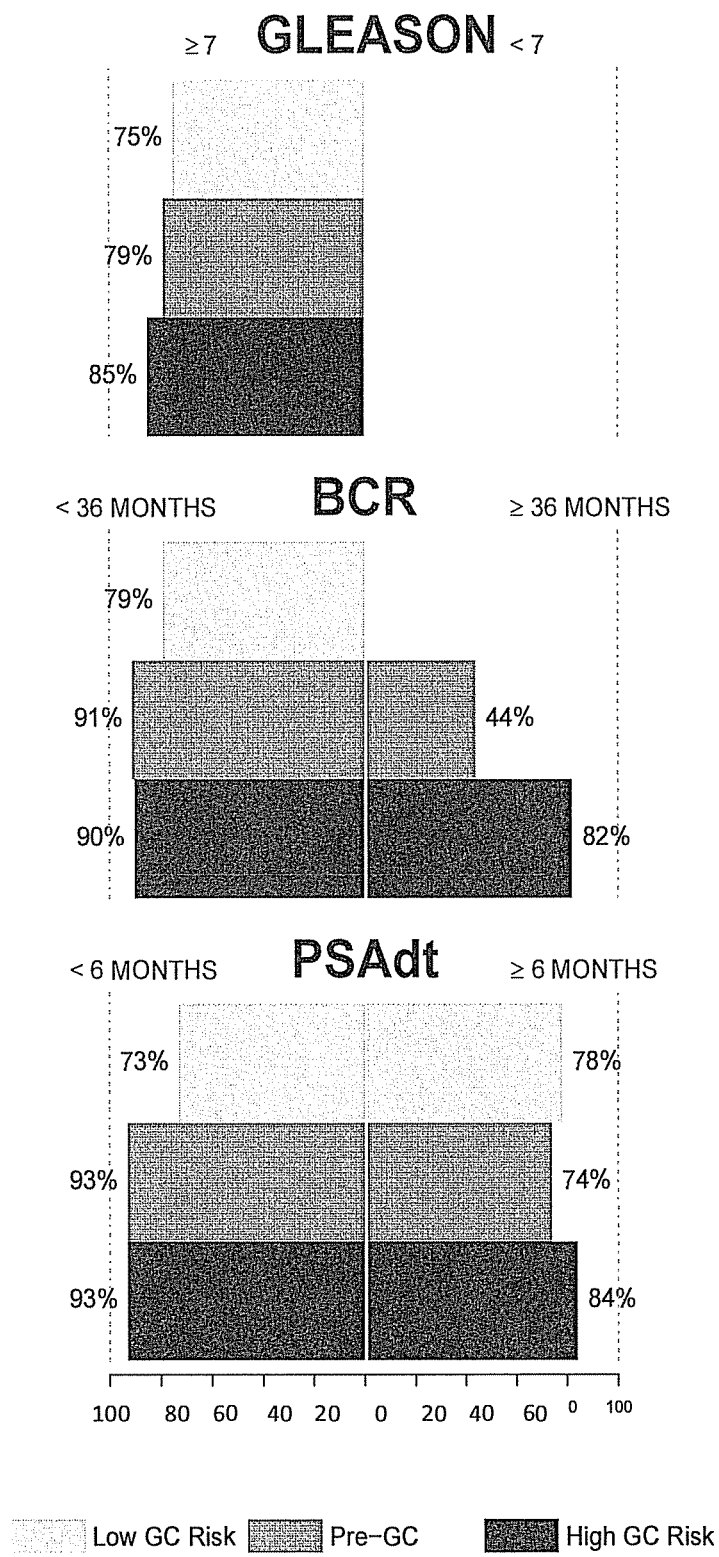
FIG. 50. Distribution of GC scores among pathological Gleason Score categories for patients with and without metastasis after Biochemical Recurrence. METS (triangle); No-METS (circle).

Discrimination plots of the GC scores for mets (right—light grey circles) and no-mets (left—dark grey circles) patients is shown in FIG. 46. Non-overlap of the notches demonstrates that the difference in GC score distribution between mets and no-mets is statistically significant. Based on the AUC of 3-year survival ROC analysis, GC shows better performance (sens/spec) than clinical measures as it outperforms clinicopathologic factors (FIG. 47) and clinical-only classifiers (FIG. 48). GC was not improved when integrating it with clinicopathologic features (GCC, FIG. 48). As this represented a high risk population, a sizable fraction of men in the study received adjuvant therapy and this could potentially confound the results. When excluding patients with adjuvant therapy, the AUC of 3-year survival ROC remained statistically significant (FIG. 49). GC score distribution among pathological Gleason Score groups showed that, while there is an overall direct correlation between both scores, GC was able to reassess the risk of many patients based on the biology of the primary tumor (FIG. 50—Mets=triangle, No-Mets=circle).

Figure 51:
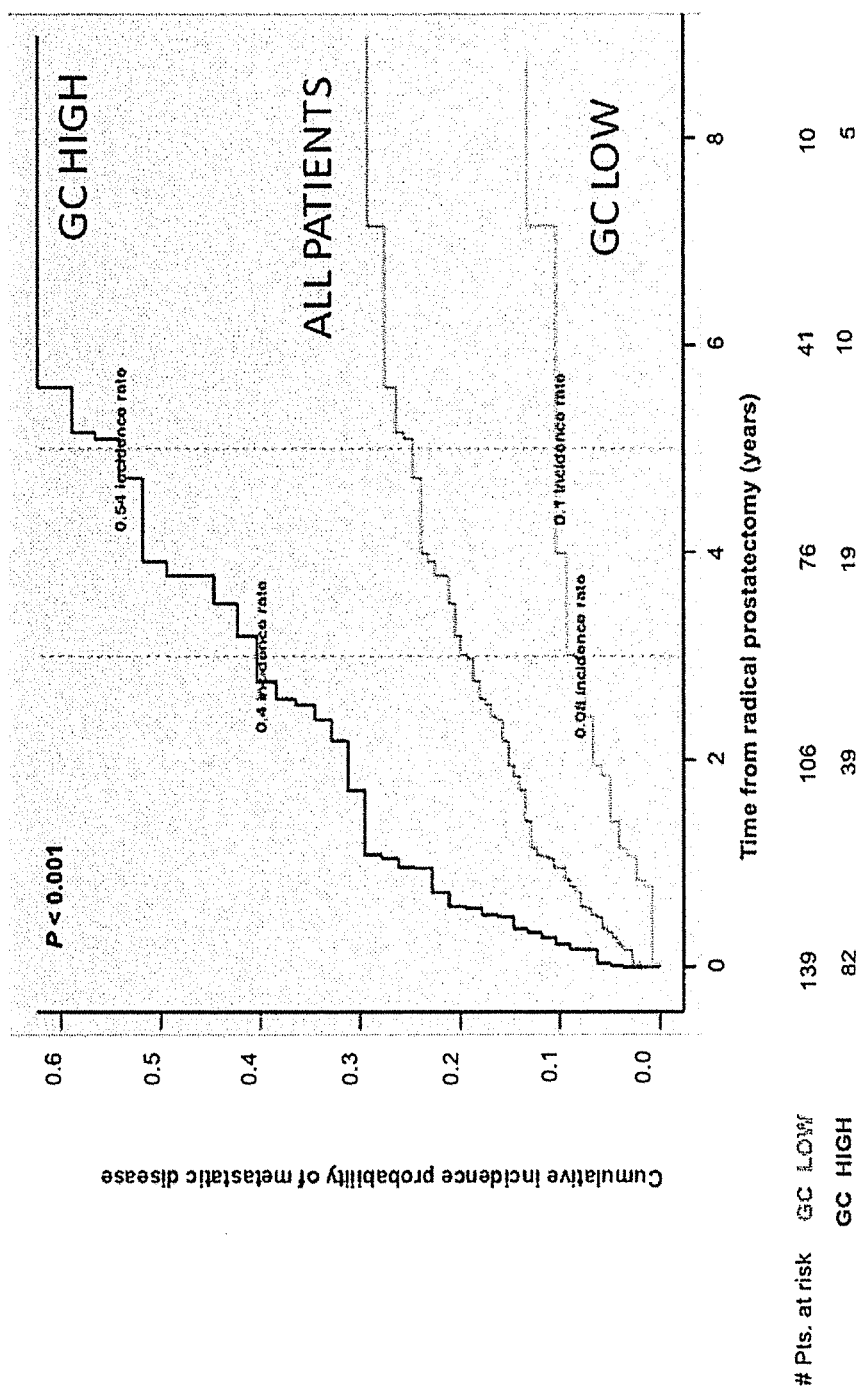
FIG. 51. Cumulative Incidence of metastasis after BCR with a GC cut-off of 0.4
Figure 52:
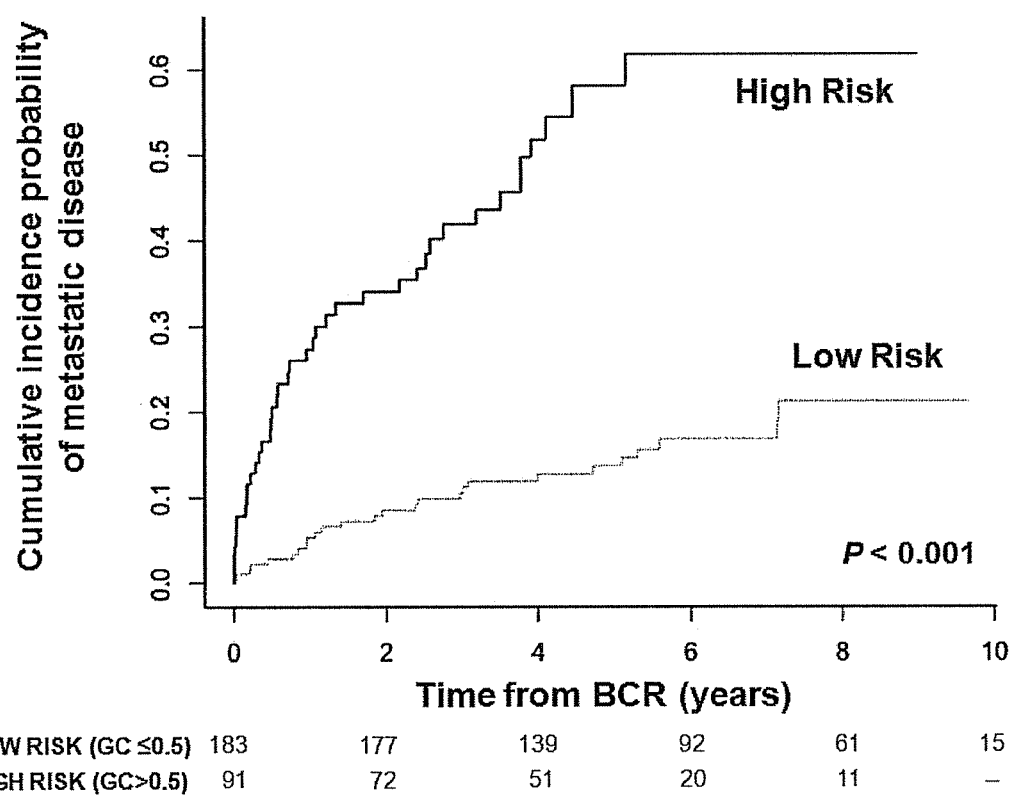
FIG. 52. Cumulative Incidence of metastasis after BCR with a GC cut-off of 0.5

The cumulative incidence of GC high risk patients were statistically higher than GC low risk patients at any point in time following BCR using an optimal ROC-based cut-off of ≥0.4, encompassing 73% of men who would develop metastasis (FIG. 51). As shown in FIG. 51, at 3 years from BCR, the GC low group has a 0.08 incidence rate and the GC high group has a 0.4 incidence rate. At 5 years from BCR, the GC low group has an incidence rate of 0.1 and the GC high group has an incidence rate of 0.54 (FIG. 51). Statistical significance was also achieved when partitioning the set of patients into low and high risk when using a cut off of 0.5 (majority-based criteria) (FIG. 52). As the KM method not only takes into consideration the number of patients at risk but also censored data (e.g., patients for which there was a loss of follow up at some point in time) to compute the proportions, the number of patients at risk for each time point in FIG. 51-52 are shown in Tables 34-35, respectively.

TABLE 34

| | Time to PCSM after BCR (years) | | | | | |
|---|---|---|---|---|---|---|
| | 0 | 2 | 4 | 6 | 8 | |
| GC Low | 139 | 106 | 76 | 41 | 10 | # Patients |
| GC High | 82 | 39 | 19 | 10 | 5 | at risk |

TABLE 35

| | Time to PCSM after BCR (years) | | | | | | |
|---|---|---|---|---|---|---|---|
| | 0 | 2 | 4 | 6 | 8 | 10 | |
| GC ≤0.5 | 183 | 177 | 139 | 92 | 61 | 15 | # Patients |
| GC >0.5 | 91 | 72 | 51 | 20 | 11 | — | at risk |

Figure 53:
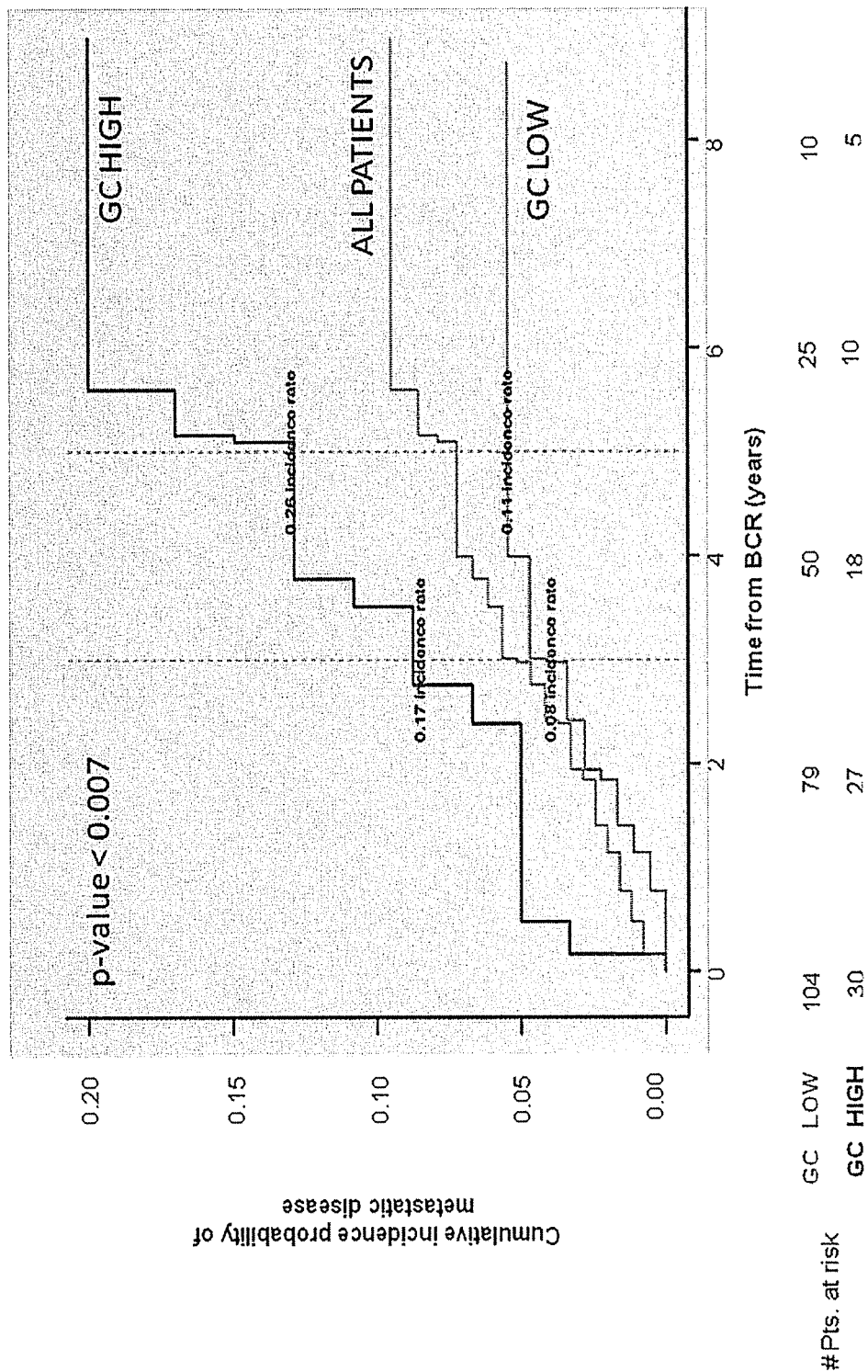
FIG. 53. Cumulative Incidence of metastasis after BCR after excluding patients with Adjuvant Treatment FIG. 54. Reclassification of BCR patients by GC FIG. 55. 3-year Decision Curve Analysis Table 1. Clinical characteristics of Discovery and Validation data set Table 2. 43-Biomarker Set. Chromosomal coordinates correspond to the hg19 version of the human genome.

As shown in FIG. 53, at 3 years, the GC low group has a 0.08 incidence rate and the GC high group has a 0.17 incidence rate; and at 5 years, the GC low group has a 0.11 incidence rate and the GC high group has a 0.26 incidence rate. Since treatment was confounded with the patient's diagnosis or disease status, we observed that by excluding treated patients we lost a group of cases, thus having a lower incidence rate for GC>=0.4 patients (FIG. 53). Still, the difference in cumulative incidence between GC high risk and GC low risk patients remained statistically significant. As the KM method not only takes into consideration the number of patients at risk but also censored data (e.g., patients for which there was a loss of follow up at some point in time) to compute the proportions, the number of patients at risk for each time point in FIG. 53 is shown in Table 36.

TABLE 36

| | Time to PCSM after BCR (years) | | | | | |
|---|---|---|---|---|---|---|
| | 0 | 2 | 4 | 6 | 8 | |
| GC Low | 104 | 79 | 50 | 25 | 10 | # Patients |
| GC High | 30 | 27 | 18 | 10 | 5 | at risk |

Figure 54:
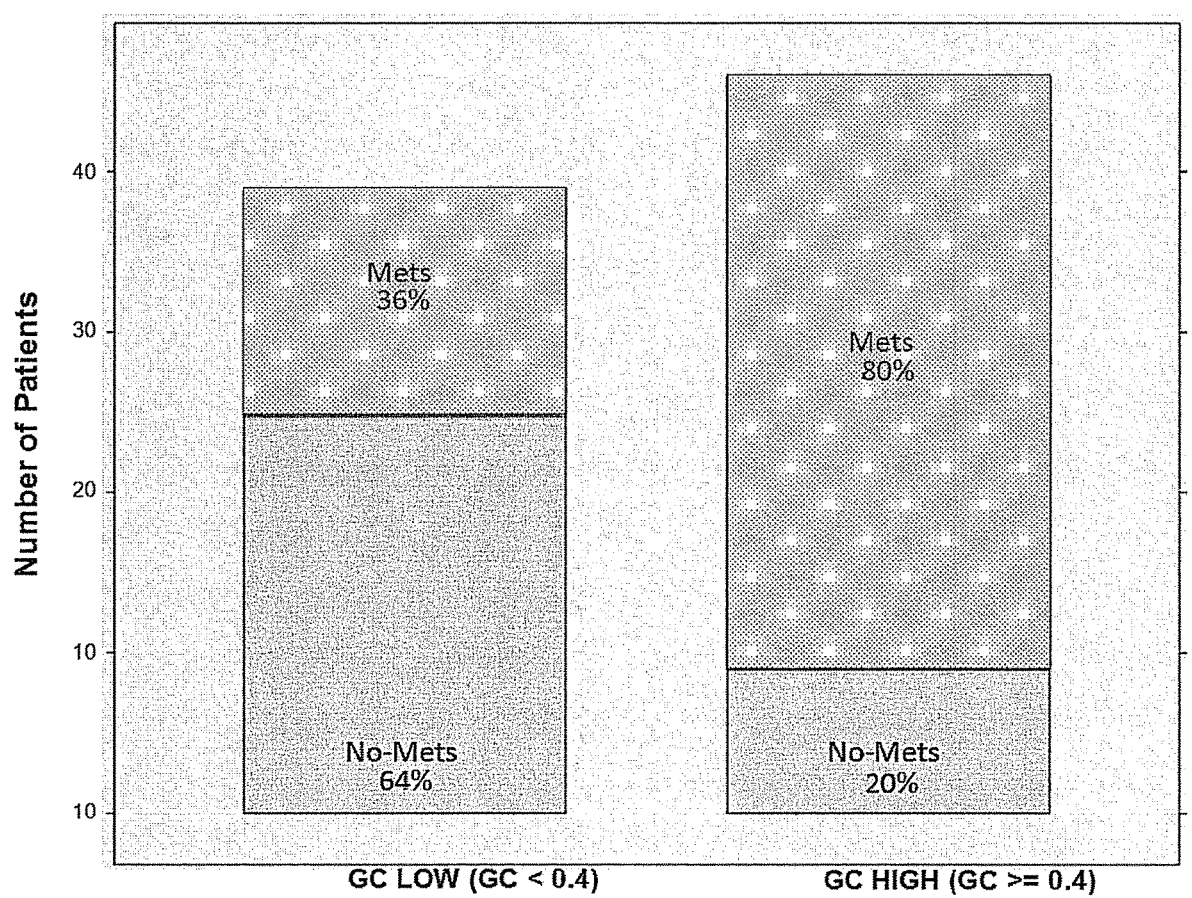

Majority of patients with GC<0.4 (64%) did not develop metastatic disease by the end of study follow-up time (FIG. 54).

Figure 55:
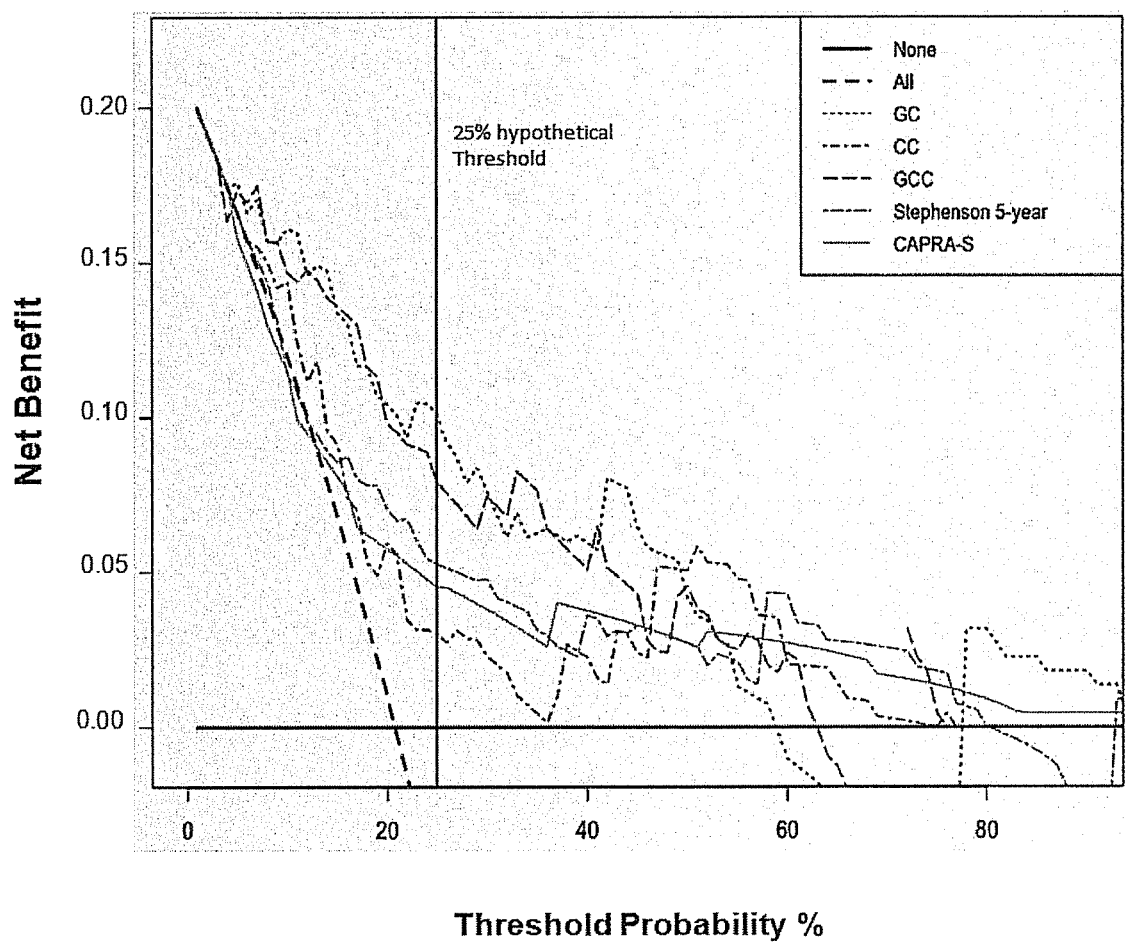

Hypothetically, if a decision to treat is made when a classifier implies a risk of 25% or higher, using the estimated net benefit, it can be shown that the reduction in unnecessary treatments among 100 patients using the GC model was 31 patients in comparison to maximum 10 patients for clinical-only models (FIG. 55).

Univariable (UVA) and Multivariable analysis (MVA) based on Cox Proportional Hazard was used to further assess the statistical significance of the classifiers and clinical variables individually (UVA) and in presence of other variables (MVA). These analyses show that GC accurately predicts metastasis following BCR. In univariable analysis, GC score predicted metastasis following BCR, as did clinicopathologic variables and clinical-only models (Table 37 and Table 38). GC score and pathological Gleason Score remained the only significant predictors of metastatic disease in a multivariable model after adjusting for clinicopathologic information (Table 37). In multivariable models involving GC and clinical-only classifiers, GC remained significant while the clinical-only classifiers were not significant (Table 38).

In summary, when compared to clinicopathologic variables, GC better predicted metastatic progression among our cohort of men with BCR following RP. These results suggested that use of GC allowed for better selection of men requiring additional treatment at the time of BCR.

TABLE 37

|  | Univariable Cox Proportional Hazard | | | Multivariable Cox Proportional Hazard | | |
| --- | --- | --- | --- | --- | --- | --- |
|  | Hazard Ratio | 95% CI | P | Hazard Ratio | 95% CI | P |
| GC | 1.62 | 1.33-1.96 | <0.001 | 1.36 | 1.09-1.68 | 0.01 |
| Path GS ≥8 | 2.55 | 1.14-5.70 | 0.02 | 2.7 | 1.02-7.16 | 0.05 |
| Pre-op PSA (log2) | 1.15 | 0.74-1.77 | 0.53 | 1.06 | 0.75-1.51 | 0.73 |
| SVI | 3.05 | 1.36-6.85 | 0.01 | 1.61 | 0.62-4.21 | 0.33 |
| SM | 0.55 | 0.25-1.25 | 0.16 | 0.63 | 0.27-1.52 | 0.31 |
| ECE | 3.02 | 1.31-6.96 | 0.01 | 1.47 | 0.62-3.48 | 0.38 |
| LNI | 5.22 | 1.93-14.13 | 0 | 0.62 | 0.18-2.15 | 0.46 |

TABLE 38

|  | Univariable Cox Proportional Hazard | | | Multivariable Cox Proportional Hazard | | |
| --- | --- | --- | --- | --- | --- | --- |
|  | Hazard Ratio | 95% CI | P | Hazard Ratio | 95% CI | P |
| GC | 1.62 | 1.33-1.96 | <0.001 | 1.4 | 1.12-1.75 | 0 |
| Stephenson | 1.51 | 1.33-1.72 | <0.001 | 1.13 | 0.92-1.37 | 0.25 |
| GC | 1.62 | 1.33-1.96 | <0.001 | 1.44 | 1.16-1.78 | <0.001 |
| CAPRA-S | 1.58 | 1.35-1.85 | <0.001 | 1.11 | 0.89-1.39 | 0.34 |

Example 12: Prognostic Value of Univariable and Pairwise Combination of Prognostic Features from a 43 Biomarker Panel for Prostate Cancer Progression Across Different Endpoints The 43 biomarkers discovered in Example 2 (Table 2) were assessed for their performance across a range of different metrics and endpoints.

In tables 39 to 48, those biomarkers that were found as univariable classifiers to be statistically significant in the training and testing sets (see Example 1) based on a Wilcoxon test (p-value<=0.05) for the Area under the ROC curve (AUC) metric, are shown for a number of relevant clinical endpoints: Extra Capsular Extension (ECE), Seminal Vesicle Invasion (SVI), Surgical Margin Status (SMS), Lymph Node Involvement (LNI), Biochemical Recurrence Event (BCR), Local Recurrence Event (LCR), Metastasis Event (Mets Event), Prostate Cancer Specific Mortality Event (PCSM), Overall Survival (OS), pathological Gleason (pathGS) and Prostate Specific Antigen Doubling Time (PSADT). Endpoints associated to a time-to-event present also metrics that allow to consider this component in the performance assessment. Whereas results are shown for the testing set (as defined in Example 1), these biomarkers were significant also in the training set of the discovery study.

Further significance of the selected features was evidenced by multiple metrics and are also listed in tables 39 to 48 (either in their raw values or as their associated P-value for assessment of statistical significance) including:

Sensitivity: proportion of the actual number of patients with the event that are correctly identified as such. Higher values indicate better performance.

Specificity: proportion of the actual number of patients without the event that are correctly identified as such. Higher values indicate better performance.

Area under the ROC curve (AUC). Corresponds to the area under the receiver operating characteristic curve, which plots the performance of a feature or classifier for all thresholds of sensitivity and specificity. Higher values indicate better performance.

Accuracy: Proportion of patients correctly predicted. Higher values indicate better performance.

Positive Predictive Value: proportion of predicted events that are true events. Higher values indicate better performance.

Negative Predictive Value: proportion of predicted non-events that are true non-events. Higher values indicate better performance.

Detection Rate: The portion of true positives from the whole population. Higher values indicate better performance.

Detection Prevalence: The portion of predicted events from the whole population. Higher values indicate better performance.

Median Fold Difference: the ratio of the median expression value for each group. Values away from 1 indicate better performance.

Survival AUC: assesses the discriminatory power of the classifier across all thresholds of sensitivity and specificity taking into account the time to event. Higher values indicate better performance.

KM P-value: Kaplan Meier curves are obtained by partitioning the expression values into low and high risk groups using the PAM clustering method. A Kaplan Meier curve for one of these groups shows the probability over time of being free of the event, given the number of patients at risk and the censored data. The p-value is computed and measures the significance of the differences between both groups over time. P-values<=0.05 are considered significant. Lower values indicate better performance.

Univariable Analysis (UVA) odds ratio: measures the effect size of the feature or classifier when partitioning the scores into low and high risk groups. For this metric, these groups are obtained by partitioning the set of samples into low and high risk values using the PAM clustering method. Values away from 1 indicate better performance.

Multivariable Analysis (MVA) odds ratio: measures the independent prognostic ability of the feature or classifier when partitioning the values into low and high risk groups. For this metric, these groups are obtained by partitioning the set of samples into low and high risk using the PAM clustering method. Values away from 1 indicate better performance.

UVA hazard ratio: measures the ratio of the hazard rates when partitioning the values into low and high risk groups and incorporates the time to event through Cox proportionate hazard modeling. For this metric, these groups are obtained by partitioning the scores into low and high risk using the PAM clustering method. Values away from 1 indicate better performance.

MVA hazard ratio: measures the independent prognostic ability relative to other variables when partitioning the values into low and high risk groups and incorporates the time to event through Cox proportionate hazard modeling. For this metric, these groups are obtained by partitioning the scores into low and high risk using the PAM clustering method. Values away from 1 indicate better performance.

The associated p-value provided for the metrics gives a measure of the statistical significance of the corresponding metric. The threshold of P-value<=0.05 is used as a way of defining those features that are statistically significant for the given metric and endpoint. The AUC lower and AUC upper, as well as the Accuracy lower and Accuracy upper, represent the lower and upper bound of the 95% Confidence Interval for those metrics.

TABLE 39 biomarkers from the 43 biomarker panel with significance for Wilcoxon P-value (auc.pvalue) and other metrics for the BCR event endpoint.

| SEQ ID NO. | auc | auc. pvalue | Accuracy | Sensitivity | Specificity | Pos.Pred. Value | Neg.Pred. Value |
|---|---|---|---|---|---|---|---|
| SEQ ID NO. 6 | 0.62 | 0.01 | 0.61 | 0.62 | 0.59 | 0.77 | 0.41 |
| SEQ ID NO. 22 | 0.60 | 0.03 | 0.59 | 0.63 | 0.52 | 0.74 | 0.38 |
| SEQ ID NO. 19 | 0.59 | 0.04 | 0.60 | 0.63 | 0.53 | 0.75 | 0.39 |
| SEQ ID NO. 28 | 0.59 | 0.04 | 0.59 | 0.64 | 0.48 | 0.73 | 0.38 |
| SEQ ID NO. 16 | 0.61 | 0.02 | 0.42 | 0.45 | 0.34 | 0.60 | 0.22 |
| SEQ ID NO. 5 | 0.60 | 0.03 | 0.61 | 0.66 | 0.50 | 0.75 | 0.40 |
| SEQ ID NO. 4 | 0.60 | 0.02 | 0.48 | 0.30 | 0.86 | 0.83 | 0.36 |

| SEQ ID NO. | mfd | uvaOR Pval | mvaORPval | KM P-value | survAUC | uvaHRP val | mvaHRP val |
|---|---|---|---|---|---|---|---|
| SEQ ID NO. 6 | 1.09 | 0.02 | 0.06 | 0.00 | 0.64 | 0.00 | 0.08 |
| SEQ ID NO. 22 | 1.15 | 0.03 | 0.09 | 0.03 | 0.64 | 0.00 | 0.01 |
| SEQ ID NO. 19 | 1.06 | 0.13 | 0.02 | 0.00 | 0.65 | 0.02 | 0.01 |
| SEQ ID NO. 28 | 1.09 | 0.06 | 0.02 | 0.08 | 0.63 | 0.01 | 0.01 |
| SEQ ID NO. 16 | 0.97 | 0.12 | 0.58 | 0.01 | 0.39 | 0.11 | 0.86 |
| SEQ ID NO. 5 | 1.08 | 0.05 | 0.05 | 0.16 | 0.54 | 0.19 | 0.52 |
| SEQ ID NO. 4 | 1.03 | 0.02 | 0.06 | 0.00 | 0.65 | 0.00 | 0.00 |

Auc. pvalue: Wilcoxon Test P-value.
MFD: Median Fold Difference.
KM: Kaplan Meier curves.
survAUC: survival AUC.
uvaORP val: Univariable Analysis Odds Ratio P-value.
mvaORP val: multivariable analysis Odds Ratio P-value.
uvaHRP val: Univariable Analysis Hazard Ratio P-value.
mvaHRP val: Multivariable Analysis Hazard Ratio P-value.

TABLE 40 biomarkers from the 43 biomarker panel with significance for Wilcoxon P-value (auc.pvalue) and other metrics for the ECE endpoint.

| SEQ ID NO. | auc | auc.pvalue | Accuracy | Sensitivity | Specificity |
|---|---|---|---|---|---|
| SEQ ID NO. 6 | 0.62 | 0.01 | 0.57 | 0.63 | 0.52 |
| SEQ ID NO. 22 | 0.65 | 0.00 | 0.59 | 0.67 | 0.51 |
| SEQ ID NO. 15 | 0.59 | 0.04 | 0.53 | 0.68 | 0.39 |
| SEQ ID NO. 19 | 0.60 | 0.02 | 0.55 | 0.63 | 0.47 |
| SEQ ID NO. 28 | 0.59 | 0.03 | 0.58 | 0.68 | 0.47 |
| SEQ ID NO. 16 | 0.59 | 0.03 | 0.45 | 0.46 | 0.43 |
| SEQ ID NO. 17 | 0.62 | 0.00 | 0.61 | 0.74 | 0.49 |
| SEQ ID NO. 10 | 0.59 | 0.04 | 0.41 | 0.32 | 0.49 |
| SEQ ID NO. 37 | 0.60 | 0.02 | 0.45 | 0.31 | 0.58 |

TABLE 40-continued biomarkers from the 43 biomarker panel with significance for Wilcoxon P-value (auc.pvalue) and other metrics for the ECE endpoint.

| SEQ ID NO. | Pos. Pred. Value | Neg. Pred. Value | mfd | uvaORPval | mvaORPval |
|---|---|---|---|---|---|
| SEQ ID NO. 6 | 0.55 | 0.59 | 1.08 | 0.01 | 0.12 |
| SEQ ID NO. 22 | 0.56 | 0.62 | 1.20 | 0.00 | 0.06 |
| SEQ ID NO. 15 | 0.52 | 0.56 | 1.04 | 0.04 | 0.10 |
| SEQ ID NO. 19 | 0.53 | 0.57 | 1.07 | 0.03 | 0.64 |
| SEQ ID NO. 28 | 0.55 | 0.61 | 1.10 | 0.02 | 0.66 |
| SEQ ID NO. 16 | 0.44 | 0.46 | 0.97 | 0.02 | 0.49 |
| SEQ ID NO. 17 | 0.58 | 0.66 | 1.06 | 0.01 | 0.28 |
| SEQ ID NO. 10 | 0.38 | 0.43 | 0.90 | 0.10 | 0.66 |
| SEQ ID NO. 37 | 0.41 | 0.47 | 0.94 | 0.02 | 0.11 | auc.pvalue: Wilcoxon Test P-value.
MFD: Median Fold Difference.
KM: Kaplan Meier curves.
uvaORPval: Univariable Analysis Odds Ratio P-value.
mvaORPval: multivariable analysis Odds Ratio P-value.

TABLE 41 biomarkers from the 43 biomarker panel with significance for Wilcoxon P-value (auc.pvalue) and other metrics for the LCR event endpoint.

| SEQ ID NO. | auc | auc.pvalue | Accuracy | Sensitivity | Specificity | Pos.Pred.Value | Neg.Pred.Value |
|---|---|---|---|---|---|---|---|
| SEQ ID NO. 4 | 0.76 | 0.00 | 0.78 | 0.67 | 0.80 | 0.30 | 0.95 |
| SEQ ID NO. 36 | 0.65 | 0.02 | 0.42 | 0.86 | 0.37 | 0.15 | 0.95 |
| SEQ ID NO. 26 | 0.64 | 0.03 | 0.54 | 0.71 | 0.52 | 0.16 | 0.93 |

| SEQ ID NO. | mfd | uvaPval | mvaPval | KM P-value | survAUC | uvaHRPval | mvaHRPval |
|---|---|---|---|---|---|---|---|
| SEQ ID NO. 4 | 1.19 | 0.00 | 0.02 | 0.00 | 0.93 | 0.00 | 0.00 |
| SEQ ID NO. 36 | 1.03 | 0.14 | 0.09 | 0.04 | 0.77 | 0.12 | 0.05 |
| SEQ ID NO. 26 | 1.06 | 0.04 | 0.03 | 0.02 | 0.78 | 0.02 | 0.01 | auc.pvalue: Wilcoxon Test P-value.
mfd: Median Fold Difference.
KM: Kaplan Meier curves.
survAUC: survival AUC.
uvaORPval: Univariable Analysis Odds Ratio P-value.
mvaORPval: multivariable analysis Odds Ratio P-value.
uvaHRPval: Univariable Analysis Hazard Ratio P-value.
mvaHRPval: Multivariable Analysis Hazard Ratio P-value.

TABLE 42 biomarkers from the 43 biomarker panel with significance for Wilcoxon P-value (auc.pvalue) and other metrics for the LNI endpoint.

| SEQ ID NO. | auc | auc.pvalue | Accuracy | Sensitivity | Specificity |
|---|---|---|---|---|---|
| SEQ ID NO. 28 | 0.66 | 0.01 | 0.49 | 0.81 | 0.43 |
| SEQ ID NO. 32 | 0.72 | 0.00 | 0.59 | 0.81 | 0.55 |
| SEQ ID NO. 17 | 0.65 | 0.01 | 0.47 | 0.81 | 0.42 |
| SEQ ID NO. 37 | 0.63 | 0.04 | 0.54 | 0.19 | 0.60 |
| SEQ ID NO. 42 | 0.62 | 0.04 | 0.31 | 0.56 | 0.27 |

| SEQ ID NO. | Pos. Pred. Value | Neg. Pred. Value | mfd | uvaORPval | mvaORPval |
|---|---|---|---|---|---|
| SEQ ID NO. 28 | 0.20 | 0.93 | 1.15 | 0.01 | 0.72 |
| SEQ ID NO. 32 | 0.23 | 0.95 | 1.18 | 0.00 | 0.21 |
| SEQ ID NO. 17 | 0.19 | 0.93 | 1.05 | 0.02 | 0.70 |
| SEQ ID NO. 37 | 0.07 | 0.81 | 0.92 | 0.07 | 0.97 |
| SEQ ID NO. 42 | 0.11 | 0.78 | 0.96 | 0.03 | 0.12 | auc.pvalue: Wilcoxon Test P-value.
MFD: Median Fold Difference.
KM: Kaplan Meier curves.
uvaORPval: Univariable Analysis Odds Ratio P-value.
mvaORPval: multivariable analysis Odds Ratio P-value.

TABLE 43 biomarkers from the 43 biomarker panel with significance for Wilcoxon P-value (auc.pvalue) and other metrics for the MET event endpoint.

| SEQ ID NO. | auc | auc. pvalue | Accuracy | Sensitivity | Specificity | Pos. Pred. Value | Neg. Pred. Value |
|---|---|---|---|---|---|---|---|
| SEQ ID NO. 6 | 0.67 | 0.00 | 0.61 | 0.72 | 0.54 | 0.48 | 0.77 |
| SEQ ID NO. 22 | 0.66 | 0.00 | 0.59 | 0.74 | 0.51 | 0.46 | 0.77 |
| SEQ ID NO. 20 | 0.65 | 0.00 | 0.60 | 0.72 | 0.53 | 0.47 | 0.77 |
| SEQ ID NO. 15 | 0.70 | 0.00 | 0.59 | 0.82 | 0.46 | 0.47 | 0.82 |
| SEQ ID NO. 19 | 0.67 | 0.00 | 0.60 | 0.74 | 0.52 | 0.47 | 0.77 |
| SEQ ID NO. 12 | 0.60 | 0.03 | 0.44 | 0.41 | 0.45 | 0.30 | 0.57 |
| SEQ ID NO. 28 | 0.66 | 0.00 | 0.58 | 0.75 | 0.48 | 0.46 | 0.77 |
| SEQ ID NO. 32 | 0.61 | 0.01 | 0.59 | 0.63 | 0.57 | 0.46 | 0.73 |
| SEQ ID NO. 16 | 0.66 | 0.00 | 0.37 | 0.34 | 0.38 | 0.24 | 0.50 |
| SEQ ID NO. 17 | 0.61 | 0.02 | 0.55 | 0.74 | 0.45 | 0.43 | 0.75 |
| SEQ ID NO. 18 | 0.61 | 0.01 | 0.58 | 0.47 | 0.64 | 0.43 | 0.68 |
| SEQ ID NO. 4 | 0.67 | 0.00 | 0.73 | 0.47 | 0.87 | 0.68 | 0.74 |
| SEQ ID NO. 2 | 0.59 | 0.04 | 0.40 | 0.46 | 0.37 | 0.30 | 0.54 |
| SEQ ID NO. 24 | 0.64 | 0.00 | 0.63 | 0.56 | 0.67 | 0.49 | 0.72 |
| SEQ ID NO. 26 | 0.59 | 0.03 | 0.56 | 0.99 | 0.59 | 0.54 | 0.43 |

| SEQ ID NO. | mfd | uva ORPval | mva ORPval | KM P-value | surv AUC | uva HRPval | mva HRPval |
|---|---|---|---|---|---|---|---|
| SEQ ID NO. 6 | 1.10 | 0.00 | 0.02 | 0.00 | 0.75 | 0.00 | 0.01 |
| SEQ ID NO. 22 | 1.24 | 0.00 | 0.04 | 0.00 | 0.69 | 0.00 | 0.00 |
| SEQ ID NO. 20 | 1.07 | 0.00 | 0.01 | 0.00 | 0.73 | 0.00 | 0.00 |
| SEQ ID NO. 15 | 1.10 | 0.00 | 0.05 | 0.00 | 0.74 | 0.00 | 0.03 |
| SEQ ID NO. 19 | 1.14 | 0.00 | 0.01 | 0.00 | 0.75 | 0.00 | 0.00 |
| SEQ ID NO. 12 | 0.96 | 0.03 | 0.20 | 0.03 | 0.31 | 0.01 | 0.01 |
| SEQ ID NO. 28 | 1.18 | 0.00 | 0.05 | 0.00 | 0.67 | 0.00 | 0.01 |
| SEQ ID NO. 32 | 1.14 | 0.01 | 0.15 | 0.01 | 0.64 | 0.00 | 0.02 |
| SEQ ID NO. 16 | 0.95 | 0.00 | 0.21 | 0.00 | 0.34 | 0.00 | 0.06 |
| SEQ ID NO. 17 | 1.04 | 0.01 | 0.23 | 0.01 | 0.67 | 0.01 | 0.09 |
| SEQ ID NO. 18 | 1.05 | 0.00 | 0.06 | 0.08 | 0.62 | 0.00 | 0.07 |
| SEQ ID NO. 4 | 1.09 | 0.00 | 0.01 | 0.00 | 0.71 | 0.00 | 0.00 |
| SEQ ID NO. 2 | 0.92 | 0.04 | 0.55 | 0.03 | 0.39 | 0.05 | 0.76 |
| SEQ ID NO. 24 | 1.12 | 0.00 | 0.00 | 0.00 | 0.72 | 0.00 | 0.00 |
| SEQ ID NO. 26 | 1.02 | 0.03 | 0.02 | 0.04 | 0.64 | 0.02 | 0.02 | auc.pvalue: Wilcoxon Test P-value.
mfd: Median Fold Difference.
KM: Kaplan Meier curves.
survAUC: survival AUC.
uvaORPval: Univariable Analysis Odds Ratio P-value.
mvaORPval: multivariable analysis Odds Ratio P-value.
uvaHRPval: Univariable Analysis Hazard Ratio P-value.
mvaHRPval: Multivariable Analysis Hazard Ratio P-value.

TABLE 44 biomarkers from the 43 biomarker panel with significance for Wilcoxon P-value (auc.pvalue) and other metrics for the OS event endpoint.

| SEQ ID NO. | auc | auc. pvalue | Accuracy | Sensitivity | Specificity | Pos.Pred. Value | Neg.Pred. Value |
|---|---|---|---|---|---|---|---|
| SEQ ID NO. 22 | 0.60 | 0.02 | 0.58 | 0.65 | 0.50 | 0.59 | 0.56 |
| SEQ ID NO. 19 | 0.60 | 0.02 | 0.54 | 0.61 | 0.47 | 0.56 | 0.52 |
| SEQ ID NO. 9 | 0.59 | 0.04 | 0.46 | 0.59 | 0.32 | 0.49 | 0.41 |
| SEQ ID NO. 17 | 0.62 | 0.00 | 0.58 | 0.68 | 0.45 | 0.58 | 0.56 |
| SEQ ID NO. 18 | 0.59 | 0.04 | 0.54 | 0.44 | 0.65 | 0.58 | 0.51 |
| SEQ ID NO. 4 | 0.65 | 0.00 | 0.63 | 0.39 | 0.90 | 0.81 | 0.57 |
| SEQ ID NO. 2 | 0.61 | 0.01 | 0.42 | 0.49 | 0.35 | 0.46 | 0.38 |

| SEQ ID NO. | mfd | uva ORPval | mva ORPval | KM P-value | surv AUC | uva HRPval | mva HRPval |
|---|---|---|---|---|---|---|---|
| SEQ ID NO. 22 | 1.18 | 0.02 | 0.12 | 0.00 | 0.61 | 0.00 | 0.03 |
| SEQ ID NO. 19 | 1.06 | 0.06 | 0.40 | 0.00 | 0.82 | 0.00 | 0.03 |
| SEQ ID NO. 9 | 0.96 | 0.03 | 0.34 | 0.66 | 0.46 | 0.20 | 0.32 |
| SEQ ID NO. 17 | 1.04 | 0.01 | 0.45 | 0.01 | 0.63 | 0.00 | 0.18 |
| SEQ ID NO. 18 | 1.03 | 0.02 | 0.23 | 0.06 | 0.62 | 0.01 | 0.44 |
| SEQ ID NO. 4 | 1.04 | 0.00 | 0.03 | 0.00 | 0.64 | 0.00 | 0.05 |
| SEQ ID NO. 2 | 0.92 | 0.01 | 0.81 | 0.13 | 0.47 | 0.20 | 0.93 | auc.pvalue: Wilcoxon Test P-value.
mfd: Median Fold Difference.
KM: Kaplan Meier curves.
survAUC: survival AUC.
uvaORPval: Univariable Analysis Odds Ratio P-value.
mvaORPval: multivariable analysis Odds Ratio P-value.
uvaHRPval: Univariable Analysis Hazard Ratio P-value.
mvaHRPval: Multivariable Analysis Hazard Ratio P-value.

TABLE 45 biomarkers from the 43 biomarker panel with significance for Wilcoxon P-value (auc.pvalue) and other metrics for the pathological Gleason endpoint.

| SEQ ID NO. | auc | auc.pvalue | Accuracy | Sensitivity |
|---|---|---|---|---|
| SEQ ID NO. 6 | 0.74 | 0.00 | 0.52 | 0.41 |
| SEQ ID NO. 22 | 0.67 | 0.02 | 0.62 | 0.63 |
| SEQ ID NO. 20 | 0.81 | 0.00 | 0.71 | 0.66 |
| SEQ ID NO. 15 | 0.79 | 0.00 | 0.70 | 0.65 |
| SEQ ID NO. 19 | 0.80 | 0.00 | 0.70 | 0.63 |
| SEQ ID NO. 12 | 0.69 | 0.01 | 0.34 | 0.34 |
| SEQ ID NO. 28 | 0.83 | 0.00 | 0.70 | 0.66 |
| SEQ ID NO. 16 | 0.77 | 0.00 | 0.39 | 0.46 |
| SEQ ID NO. 9 | 0.65 | 0.05 | 0.58 | 0.66 |
| SEQ ID NO. 17 | 0.74 | 0.00 | 0.73 | 0.73 |
| SEQ ID NO. 18 | 0.72 | 0.00 | 0.60 | 0.54 |
| SEQ ID NO. 4 | 0.69 | 0.01 | 0.44 | 0.30 |
| SEQ ID NO. 24 | 0.68 | 0.02 | 0.53 | 0.45 |
| SEQ ID NO. 40 | 0.69 | 0.01 | 0.55 | 0.68 |
| SEQ ID NO. 26 | 0.69 | 0.01 | 0.66 | 0.66 |

| SEQ ID NO. | Specificity | Pos.Pred. Value | Neg.Pred. Value | mfd | uvaORPval |
|---|---|---|---|---|---|
| SEQ ID NO. 6 | 0.94 | 0.97 | 0.29 | 1.21 | 0.00 |
| SEQ ID NO. 22 | 0.56 | 0.85 | 0.28 | 1.29 | 0.03 |
| SEQ ID NO. 20 | 0.89 | 0.96 | 0.40 | 1.13 | 0.00 |
| SEQ ID NO. 15 | 0.89 | 0.96 | 0.39 | 1.18 | 0.00 |
| SEQ ID NO. 19 | 0.94 | 0.98 | 0.40 | 1.25 | 0.00 |

TABLE 45-continued biomarkers from the 43 biomarker panel with significance for Wilcoxon P-value (auc.pvalue) and other metrics for the pathological Gleason endpoint.

| | | | | | |
|---|---|---|---|---|---|
| SEQ ID NO. 12 | 0.33 | 0.67 | 0.11 | 0.89 | 0.01 |
| SEQ ID NO. 28 | 0.83 | 0.94 | 0.38 | 1.62 | 0.00 |
| SEQ ID NO. 16 | 0.11 | 0.67 | 0.05 | 0.91 | 0.00 |
| SEQ ID NO. 9 | 0.28 | 0.78 | 0.17 | 0.92 | 0.05 |
| SEQ ID NO. 17 | 0.72 | 0.91 | 0.41 | 1.17 | 0.00 |
| SEQ ID NO. 18 | 0.83 | 0.93 | 0.31 | 1.17 | 0.02 |
| SEQ ID NO. 4 | 1.00 | 1.00 | 0.26 | 1.05 | 0.01 |
| SEQ ID NO. 24 | 0.83 | 0.91 | 0.28 | 1.20 | 0.04 |
| SEQ ID NO. 40 | 0.06 | 0.74 | 0.04 | 0.97 | 0.02 |
| SEQ ID NO. 26 | 0.67 | 0.89 | 0.33 | 1.08 | 0.03 | auc.pvalue: Wilcoxon Test P-value.
mfd: Median Fold Difference.
uvaORPval: Univariable Analysis Odds Ratio P-value.

TABLE 46 biomarkers from the 43 biomarker panel with significance for Wilcoxon P-value (auc.pvalue) and other metrics for the PCSM event endpoint.

| SEQ ID NO. | auc | auc. pvalue | Accuracy | Sensitivity | Specificity | Pos.Pred. Value | Neg.Pred. Value |
|---|---|---|---|---|---|---|---|
| SEQ ID NO. 6 | 0.72 | 0.00 | 0.56 | 0.81 | 0.51 | 0.28 | 0.92 |
| SEQ ID NO. 22 | 0.71 | 0.00 | 0.55 | 0.83 | 0.48 | 0.28 | 0.92 |
| SEQ ID NO. 20 | 0.71 | 0.00 | 0.54 | 0.78 | 0.49 | 0.27 | 0.90 |
| SEQ ID NO. 15 | 0.67 | 0.00 | 0.49 | 0.86 | 0.41 | 0.26 | 0.92 |
| SEQ ID NO. 19 | 0.73 | 0.00 | 0.54 | 0.81 | 0.48 | 0.27 | 0.91 |
| SEQ ID NO. 12 | 0.68 | 0.00 | 0.40 | 0.25 | 0.44 | 0.10 | 0.71 |
| SEQ ID NO. 28 | 0.74 | 0.00 | 0.57 | 0.94 | 0.48 | 0.30 | 0.97 |
| SEQ ID NO. 43 | 0.61 | 0.03 | 0.52 | 0.69 | 0.47 | 0.24 | 0.87 |
| SEQ ID NO. 32 | 0.66 | 0.00 | 0.58 | 0.72 | 0.55 | 0.28 | 0.89 |
| SEQ ID NO. 16 | 0.70 | 0.00 | 0.39 | 0.25 | 0.42 | 0.09 | 0.70 |
| SEQ ID NO. 17 | 0.61 | 0.05 | 0.48 | 0.75 | 0.41 | 0.23 | 0.87 |
| SEQ ID NO. 18 | 0.66 | 0.00 | 0.65 | 0.61 | 0.65 | 0.30 | 0.88 |
| SEQ ID NO. 4 | 0.72 | 0.00 | 0.78 | 0.58 | 0.83 | 0.45 | 0.89 |
| SEQ ID NO. 24 | 0.70 | 0.00 | 0.63 | 0.61 | 0.63 | 0.29 | 0.87 |
| SEQ ID NO. 40 | 0.61 | 0.03 | 0.35 | 0.53 | 0.31 | 0.16 | 0.73 |
| SEQ ID NO. 26 | 0.66 | 0.00 | 0.59 | 0.75 | 0.55 | 0.29 | 0.90 |

| SEQ ID NO. | mfd | uva OR Pval | mva OR Pval | KM P-value | surv AUC | uva HRPval | mva HRPval |
|---|---|---|---|---|---|---|---|
| SEQ ID NO. 6 | 1.16 | 0.00 | 0.04 | 0.00 | 0.79 | 0.00 | 0.02 |
| SEQ ID NO. 22 | 1.26 | 0.00 | 0.05 | 0.00 | 0.73 | 0.00 | 0.05 |
| SEQ ID NO. 20 | 1.12 | 0.00 | 0.01 | 0.00 | 0.82 | 0.00 | 0.00 |
| SEQ ID NO. 15 | 1.07 | 0.00 | 0.23 | 0.00 | 0.63 | 0.00 | 0.33 |
| SEQ ID NO. 19 | 1.18 | 0.00 | 0.03 | 0.00 | 0.87 | 0.00 | 0.01 |
| SEQ ID NO. 12 | 0.92 | 0.00 | 0.19 | 0.00 | 0.29 | 0.00 | 0.01 |
| SEQ ID NO. 28 | 1.21 | 0.00 | 0.01 | 0.00 | 0.76 | 0.00 | 0.00 |
| SEQ ID NO. 43 | 1.01 | 0.02 | 0.01 | 0.11 | 0.44 | 0.03 | 0.07 |

TABLE 46-continued biomarkers from the 43 biomarker panel with significance for Wilcoxon
P-value (auc.pvalue) and other metrics for the PCSM event endpoint.

| SEQ ID NO. | | | | | | | |
|---|---|---|---|---|---|---|---|
| SEQ ID NO. 32 | 1.14 | 0.00 | 0.29 | 0.00 | 0.75 | 0.00 | 0.21 |
| SEQ ID NO. 16 | 0.93 | 0.00 | 0.24 | 0.00 | 0.40 | 0.00 | 0.04 |
| SEQ ID NO. 17 | 1.05 | 0.06 | 0.80 | 0.04 | 0.58 | 0.03 | 0.46 |
| SEQ ID NO. 18 | 1.11 | 0.00 | 0.05 | 0.00 | 0.73 | 0.00 | 0.18 |
| SEQ ID NO. 4 | 1.17 | 0.00 | 0.02 | 0.00 | 0.77 | 0.00 | 0.03 |
| SEQ ID NO. 24 | 1.20 | 0.00 | 0.01 | 0.00 | 0.87 | 0.00 | 0.00 |
| SEQ ID NO. 40 | 0.98 | 0.03 | 0.71 | 0.11 | 0.47 | 0.04 | 0.89 |
| SEQ ID NO. 26 | 1.05 | 0.01 | 0.06 | 0.00 | 0.71 | 0.00 | 0.12 | auc.pvalue: Wilcoxon Test P-value.
mfd: Median Fold Difference.
KM: Kaplan Meier curves.
survAUC: survival AUC.
uvaORPval: Univariable Analysis Odds Ratio P-value.
mvaORPval: multivariable analysis Odds Ratio P-value.
uvaHRPval: Univariable Analysis Hazard Ratio P-value.
mvaHRPval: Multivariable Analysis Hazard Ratio P-value.

TABLE 47 biomarkers from the 43 biomarker panel with significance for Wilcoxon P-value
(auc.pvalue) and other metrics for the psaDT endpoint.

| SEQ ID NO. | auc | auc. pvalue | Accuracy | Sensitivity | Specificity | Pos. Pred. Value | Neg. Pred. Value | mfd | uva OR Pval | mva OR Pval |
|---|---|---|---|---|---|---|---|---|---|---|
| SEQ ID NO. 6 | 0.62 | 0.02 | 0.43 | 0.52 | 0.38 | 0.32 | 0.58 | 0.97 | 0.01 | 0.07 |
| SEQ ID NO. 28 | 0.62 | 0.03 | 0.40 | 0.43 | 0.38 | 0.28 | 0.54 | 0.83 | 0.01 | 0.30 |
| SEQ ID NO. 16 | 0.62 | 0.02 | 0.56 | 0.57 | 0.56 | 0.42 | 0.70 | 1.04 | 0.04 | 0.02 | auc.pvalue: Wilcoxon Test P-value.
mfd: Median Fold Difference.
uvaORPval: Univariable Analysis Odds Ratio P-value.
mvaORPval: multivariable analysis Odds Ratio P-value.

TABLE 48 biomarkers from the 43 biomarker panel with significance for Wilcoxon P-value
(auc.pvalue) and other metrics for the SVI endpoint.

| SEQ ID NO. | auc | auc. pvalue | Accuracy | Sensitivity | Specificity | Pos.Pred. Value | Neg.Pred. Value | mfd | uva ORP val | mvaOR Pval |
|---|---|---|---|---|---|---|---|---|---|---|
| SEQ ID NO. 6 | 0.63 | 0.00 | 0.56 | 0.67 | 0.51 | 0.43 | 0.73 | 1.08 | 0.00 | 0.08 |
| SEQ ID NO. 22 | 0.60 | 0.03 | 0.53 | 0.65 | 0.46 | 0.40 | 0.71 | 1.08 | 0.02 | 0.15 |
| SEQ ID NO. 19 | 0.64 | 0.00 | 0.56 | 0.70 | 0.49 | 0.43 | 0.75 | 1.09 | 0.00 | 0.04 |
| SEQ ID NO. 17 | 0.67 | 0.00 | 0.58 | 0.77 | 0.47 | 0.44 | 0.79 | 1.06 | 0.00 | 0.02 |
| SEQ ID NO. 18 | 0.61 | 0.01 | 0.63 | 0.55 | 0.68 | 0.49 | 0.73 | 1.10 | 0.04 | 0.08 |
| SEQ ID NO. 4 | 0.69 | 0.00 | 0.68 | 0.41 | 0.83 | 0.57 | 0.72 | 1.09 | 0.00 | 0.02 |
| SEQ ID NO. 26 | 0.61 | 0.01 | 0.59 | 0.64 | 0.57 | 0.45 | 0.74 | 1.04 | 0.07 | 0.09 | auc.pvalue: Wilcoxon Test P-value.
mfd: Median Fold Difference.
uvaORPval: Univariable Analysis Odds Ratio P-value.
mvaORPval: multivariable analysis Odds Ratio P-value.

In addition to the good performance of these variables as univariable predictors, the combination of them in pairs (pairwise classifiers) through a machine learning algorithm results in enhanced performance. As shown in Tables 49 to 52, pairwise classifiers can result in an improved performance for a given endpoint compared to their univariable counterparts, with all the classifiers listed presenting statistical significance based on, at least, Wilcoxon P-value. In those tables, each classifier name is described by the machine learning algorithm that combines the biomarkers as well as the SEQ ID NO of the corresponding biomarkers (Table 2, Table 11). The machine learning algorithms included in this analysis are Naïve Bayes (NB), recursive Partitioning (Rpart), Support Vector Machines (SVMs), Random Forest (RF) and K Nearest Neighbors (KNN). These machine learning algorithms were executed with default parameters using packages rpart 4.1-0, HDclassif 1.2.2, randomForest 4.6-7, caret 5.15-61, cluster 1.14.3, e1071 1.6-1, class 7.3-5 in R. Tables 49 to 52 contain metrics and endpoints described above for tables 39 to 48.

TABLE 49 pairwise biomarkers from the 43 biomarker panel with significance for Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~5 + 6 | 0.68 | 0.00 | 0.42 | 0.78 | 0.81 | 0.38 | 0.01 | 0.03 |
| knn~5 + 19 | 0.67 | 0.00 | 0.59 | 0.69 | 0.81 | 0.43 | 0.00 | 0.00 |
| rpart~4 + 39 | 0.66 | 0.00 | 0.42 | 0.81 | 0.83 | 0.39 | 0.00 | 0.00 |
| nb~13 + 6 | 0.67 | 0.00 | 0.50 | 0.84 | 0.88 | 0.43 | 0.00 | 0.03 |
| rpart~40 + 19 | 0.66 | 0.00 | 0.76 | 0.38 | 0.73 | 0.42 | 0.03 | 0.12 |
| svm~16 + 5 | 0.65 | 0.00 | 0.58 | 0.71 | 0.81 | 0.43 | 0.00 | 0.50 |
| rf~4 + 39 | 0.65 | 0.00 | 0.57 | 0.67 | 0.79 | 0.41 | 0.00 | 0.00 |
| rpart~4 + 1 | 0.64 | 0.00 | 0.60 | 0.62 | 0.78 | 0.41 | 0.00 | 0.03 |
| rpart~13 + 6 | 0.64 | 0.00 | 0.50 | 0.79 | 0.84 | 0.42 | 0.00 | 0.07 |
| svm~16 + 6 | 0.65 | 0.00 | 0.48 | 0.72 | 0.79 | 0.39 | 0.00 | 0.05 |
| nb~4 + 16 | 0.65 | 0.00 | 0.30 | 0.88 | 0.84 | 0.36 | 0.00 | 0.01 |
| nb~4 + 13 | 0.65 | 0.00 | 0.26 | 0.91 | 0.87 | 0.36 | 0.00 | 0.00 |
| svm~4 + 39 | 0.65 | 0.00 | 0.45 | 0.81 | 0.84 | 0.40 | 0.00 | 0.00 |
| knn~18 + 28 | 0.64 | 0.00 | 0.68 | 0.50 | 0.75 | 0.41 | 0.01 | 0.11 |
| nb~9 + 6 | 0.65 | 0.00 | 0.54 | 0.66 | 0.78 | 0.39 | 0.00 | 0.15 |
| nb~4 + 1 | 0.64 | 0.00 | 0.35 | 0.86 | 0.85 | 0.38 | 0.00 | 0.00 |
| rpart~18 + 13 | 0.64 | 0.00 | 0.52 | 0.67 | 0.78 | 0.39 | 0.01 | 0.89 |
| svm~4 + 16 | 0.64 | 0.00 | 0.40 | 0.76 | 0.78 | 0.36 | 0.01 | 0.02 |
| nb~18 + 13 | 0.64 | 0.00 | 0.57 | 0.64 | 0.78 | 0.40 | 0.01 | 0.21 |
| rf~13 + 6 | 0.64 | 0.00 | 0.56 | 0.66 | 0.78 | 0.40 | 0.00 | 0.25 |
| svm~4 + 24 | 0.64 | 0.00 | 0.29 | 0.86 | 0.82 | 0.35 | 0.00 | 0.00 |
| svm~4 + 6 | 0.64 | 0.00 | 0.40 | 0.79 | 0.81 | 0.37 | 0.00 | 0.05 |
| rpart~13 + 26 | 0.64 | 0.00 | 0.38 | 0.83 | 0.83 | 0.38 | 0.00 | 0.01 |
| nb~1 + 6 | 0.64 | 0.00 | 0.37 | 0.78 | 0.78 | 0.36 | 0.04 | 0.03 |
| knn~18 + 10 | 0.64 | 0.00 | 0.69 | 0.45 | 0.73 | 0.39 | 0.05 | 0.52 |
| nb~4 + 32 | 0.64 | 0.00 | 0.32 | 0.86 | 0.84 | 0.36 | 0.00 | 0.00 |
| rf~19 + 3 | 0.64 | 0.00 | 0.54 | 0.71 | 0.80 | 0.41 | 0.00 | 0.00 |
| knn~13 + 22 | 0.64 | 0.00 | 0.73 | 0.43 | 0.74 | 0.42 | 0.01 | 0.10 |
| nb~13 + 19 | 0.64 | 0.00 | 0.63 | 0.62 | 0.79 | 0.43 | 0.00 | 0.00 |
| rpart~5 + 28 | 0.63 | 0.00 | 0.57 | 0.62 | 0.77 | 0.40 | 0.01 | 0.23 |
| rpart~24 + 22 | 0.63 | 0.00 | 0.41 | 0.81 | 0.83 | 0.38 | 0.00 | 0.00 |
| svm~5 + 28 | 0.64 | 0.00 | 0.49 | 0.72 | 0.80 | 0.39 | 0.01 | 0.29 |
| svm~15 + 5 | 0.64 | 0.00 | 0.31 | 0.84 | 0.82 | 0.36 | 0.03 | 0.22 |
| nb~5 + 6 | 0.64 | 0.00 | 0.36 | 0.81 | 0.81 | 0.36 | 0.01 | 0.05 |
| rpart~13 + 20 | 0.64 | 0.00 | 0.54 | 0.62 | 0.76 | 0.38 | 0.06 | 0.01 |
| svm~5 + 19 | 0.64 | 0.00 | 0.57 | 0.64 | 0.78 | 0.40 | 0.01 | 0.04 |
| knn~5 + 22 | 0.63 | 0.00 | 0.54 | 0.71 | 0.80 | 0.41 | 0.00 | 0.03 |
| knn~18 + 13 | 0.63 | 0.00 | 0.71 | 0.43 | 0.73 | 0.40 | 0.06 | 0.27 |
| svm~13 + 6 | 0.64 | 0.00 | 0.47 | 0.79 | 0.83 | 0.40 | 0.00 | 0.10 |
| rf~4 + 19 | 0.64 | 0.00 | 0.50 | 0.74 | 0.81 | 0.40 | 0.00 | 0.00 |
| nb~16 + 5 | 0.64 | 0.00 | 0.61 | 0.62 | 0.78 | 0.42 | 0.02 | 0.33 |
| knn~4 + 19 | 0.63 | 0.00 | 0.51 | 0.76 | 0.82 | 0.41 | 0.00 | 0.02 |
| nb~16 + 6 | 0.64 | 0.00 | 0.44 | 0.78 | 0.81 | 0.38 | 0.00 | 0.07 |
| nb~4 + 6 | 0.64 | 0.00 | 0.36 | 0.83 | 0.82 | 0.37 | 0.00 | 0.01 |
| svm~4 + 5 | 0.64 | 0.00 | 0.55 | 0.67 | 0.79 | 0.40 | 0.01 | 0.27 |
| rf~13 + 22 | 0.63 | 0.00 | 0.60 | 0.66 | 0.79 | 0.43 | 0.00 | 0.08 |
| rpart~4 + 32 | 0.63 | 0.00 | 0.41 | 0.76 | 0.79 | 0.37 | 0.01 | 0.00 |
| knn~4 + 39 | 0.63 | 0.00 | 0.70 | 0.47 | 0.74 | 0.42 | 0.01 | 0.00 |
| rf~18 + 8 | 0.63 | 0.00 | 0.55 | 0.67 | 0.79 | 0.41 | 0.01 | 0.36 |
| knn~4 + 22 | 0.63 | 0.00 | 0.67 | 0.55 | 0.77 | 0.43 | 0.00 | 0.02 |
| rpart~11 + 5 | 0.63 | 0.00 | 0.41 | 0.78 | 0.80 | 0.37 | 0.07 | 0.09 |
| rpart~9 + 6 | 0.63 | 0.00 | 0.50 | 0.74 | 0.81 | 0.40 | 0.00 | 0.27 |
| knn~17 + 5 | 0.63 | 0.00 | 0.53 | 0.69 | 0.79 | 0.40 | 0.01 | 0.06 |
| rpart~29 + 22 | 0.63 | 0.00 | 0.54 | 0.64 | 0.77 | 0.39 | 0.01 | 0.02 |
| svm~16 + 18 | 0.63 | 0.00 | 0.41 | 0.72 | 0.76 | 0.36 | 0.06 | 0.22 |
| knn~8 + 22 | 0.63 | 0.00 | 0.48 | 0.72 | 0.79 | 0.39 | 0.00 | 0.07 |
| nb~4 + 28 | 0.63 | 0.00 | 0.34 | 0.83 | 0.81 | 0.36 | 0.00 | 0.00 |
| svm~15 + 19 | 0.63 | 0.00 | 0.30 | 0.86 | 0.83 | 0.36 | 0.01 | 0.08 |
| nb~13 + 22 | 0.63 | 0.00 | 0.48 | 0.72 | 0.79 | 0.39 | 0.01 | 0.01 |
| rf~7 + 19 | 0.63 | 0.00 | 0.63 | 0.62 | 0.79 | 0.43 | 0.00 | 0.98 |

TABLE 49-continued pairwise biomarkers from the 43 biomarker panel with significance for
Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| knn~4 + 9 | 0.63 | 0.00 | 0.44 | 0.76 | 0.80 | 0.38 | 0.00 | 0.01 |
| rf~4 + 38 | 0.63 | 0.00 | 0.44 | 0.76 | 0.80 | 0.38 | 0.00 | 0.33 |
| svm~9 + 6 | 0.63 | 0.00 | 0.44 | 0.72 | 0.78 | 0.37 | 0.01 | 0.40 |
| rf~16 + 18 | 0.63 | 0.00 | 0.51 | 0.72 | 0.80 | 0.40 | 0.01 | 0.12 |
| rf~42 + 19 | 0.63 | 0.00 | 0.57 | 0.66 | 0.78 | 0.41 | 0.00 | 0.00 |
| rpart~18 + 32 | 0.63 | 0.00 | 0.49 | 0.67 | 0.77 | 0.38 | 0.02 | 0.07 |
| knn~29 + 18 | 0.63 | 0.00 | 0.45 | 0.76 | 0.81 | 0.39 | 0.01 | 0.57 |
| rf~12 + 38 | 0.63 | 0.01 | 0.45 | 0.74 | 0.79 | 0.38 | 0.02 | 0.36 |
| rf~4 + 8 | 0.63 | 0.01 | 0.65 | 0.55 | 0.76 | 0.42 | 0.00 | 0.02 |
| knn~11 + 5 | 0.62 | 0.01 | 0.72 | 0.45 | 0.74 | 0.42 | 0.05 | 0.42 |
| rf~4 + 1 | 0.63 | 0.01 | 0.52 | 0.67 | 0.78 | 0.39 | 0.01 | 0.07 |
| rf~16 + 39 | 0.63 | 0.01 | 0.49 | 0.69 | 0.78 | 0.38 | 0.01 | 0.74 |
| nb~33 + 6 | 0.63 | 0.01 | 0.41 | 0.79 | 0.82 | 0.38 | 0.01 | 0.21 |
| nb~32 + 6 | 0.63 | 0.01 | 0.31 | 0.90 | 0.87 | 0.37 | 0.00 | 0.04 |
| svm~13 + 28 | 0.63 | 0.01 | 0.47 | 0.72 | 0.79 | 0.38 | 0.01 | 0.00 |
| svm~1 + 6 | 0.63 | 0.01 | 0.41 | 0.72 | 0.76 | 0.36 | 0.03 | 0.07 |
| svm~9 + 19 | 0.63 | 0.01 | 0.54 | 0.64 | 0.77 | 0.39 | 0.01 | 0.05 |
| knn~5 + 6 | 0.62 | 0.01 | 0.51 | 0.76 | 0.82 | 0.41 | 0.00 | 0.20 |
| nb~28 + 6 | 0.63 | 0.01 | 0.46 | 0.76 | 0.81 | 0.39 | 0.00 | 0.01 |
| rpart~4 + 31 | 0.62 | 0.01 | 0.49 | 0.74 | 0.81 | 0.40 | 0.00 | 0.00 |
| knn~16 + 39 | 0.62 | 0.01 | 0.71 | 0.38 | 0.72 | 0.37 | 0.23 | 0.62 |
| svm~5 + 32 | 0.63 | 0.01 | 0.42 | 0.78 | 0.81 | 0.38 | 0.05 | 0.29 |
| rpart~4 + 18 | 0.62 | 0.01 | 0.44 | 0.71 | 0.77 | 0.36 | 0.01 | 0.33 |
| rpart~16 + 20 | 0.62 | 0.01 | 0.60 | 0.60 | 0.77 | 0.41 | 0.00 | 0.04 |
| knn~32 + 6 | 0.62 | 0.01 | 0.46 | 0.72 | 0.79 | 0.38 | 0.01 | 0.02 |
| svm~4 + 15 | 0.63 | 0.01 | 0.26 | 0.84 | 0.79 | 0.34 | 0.01 | 0.01 |
| nb~7 + 6 | 0.62 | 0.01 | 0.45 | 0.78 | 0.82 | 0.39 | 0.00 | 0.54 |
| knn~18 + 6 | 0.62 | 0.01 | 0.41 | 0.79 | 0.82 | 0.38 | 0.01 | 0.58 |
| knn~39 + 22 | 0.62 | 0.01 | 0.53 | 0.67 | 0.78 | 0.39 | 0.00 | 0.06 |
| rf~18 + 13 | 0.62 | 0.01 | 0.55 | 0.64 | 0.77 | 0.39 | 0.02 | 0.30 |
| rpart~20 + 6 | 0.62 | 0.01 | 0.49 | 0.66 | 0.76 | 0.37 | 0.02 | 0.04 |
| svm~19 + 28 | 0.62 | 0.01 | 0.43 | 0.76 | 0.80 | 0.38 | 0.01 | 0.01 |
| svm~19 + 6 | 0.62 | 0.01 | 0.44 | 0.74 | 0.79 | 0.37 | 0.00 | 0.01 |
| knn~12 + 22 | 0.62 | 0.01 | 0.45 | 0.76 | 0.81 | 0.39 | 0.00 | 0.00 |
| knn~20 + 6 | 0.62 | 0.01 | 0.59 | 0.55 | 0.75 | 0.38 | 0.03 | 0.03 |
| nb~1 + 22 | 0.62 | 0.01 | 0.49 | 0.59 | 0.72 | 0.34 | 0.31 | 0.01 |
| nb~15 + 13 | 0.62 | 0.01 | 0.45 | 0.72 | 0.78 | 0.37 | 0.03 | 0.42 |
| nb~16 + 18 | 0.62 | 0.01 | 0.50 | 0.67 | 0.77 | 0.38 | 0.02 | 0.27 |
| nb~4 + 9 | 0.62 | 0.01 | 0.37 | 0.86 | 0.85 | 0.38 | 0.00 | 0.04 |
| nb~9 + 22 | 0.62 | 0.01 | 0.41 | 0.74 | 0.78 | 0.36 | 0.03 | 0.12 |
| svm~18 + 6 | 0.62 | 0.01 | 0.38 | 0.78 | 0.79 | 0.36 | 0.01 | 0.09 |
| knn~4 + 16 | 0.62 | 0.01 | 0.54 | 0.66 | 0.78 | 0.39 | 0.01 | 0.01 |
| rf~18 + 9 | 0.62 | 0.01 | 0.48 | 0.69 | 0.77 | 0.37 | 0.05 | 0.27 |
| nb~5 + 19 | 0.62 | 0.01 | 0.61 | 0.53 | 0.74 | 0.38 | 0.09 | 0.05 |
| svm~4 + 41 | 0.62 | 0.01 | 0.27 | 0.88 | 0.83 | 0.35 | 0.00 | 0.03 |
| nb~4 + 36 | 0.62 | 0.01 | 0.22 | 0.88 | 0.80 | 0.34 | 0.01 | 0.01 |
| nb~4 + 5 | 0.62 | 0.01 | 0.36 | 0.84 | 0.84 | 0.37 | 0.00 | 0.02 |
| svm~24 + 6 | 0.62 | 0.01 | 0.34 | 0.83 | 0.81 | 0.36 | 0.00 | 0.09 |
| nb~36 + 6 | 0.62 | 0.01 | 0.40 | 0.81 | 0.82 | 0.38 | 0.00 | 0.05 |
| rpart~4 + 28 | 0.62 | 0.01 | 0.39 | 0.79 | 0.81 | 0.37 | 0.00 | 0.04 |
| svm~5 + 22 | 0.62 | 0.01 | 0.48 | 0.71 | 0.78 | 0.38 | 0.03 | 0.01 |
| rpart~39 + 18 | 0.61 | 0.01 | 0.45 | 0.71 | 0.77 | 0.37 | 0.02 | 0.52 |
| rf~4 + 31 | 0.62 | 0.01 | 0.47 | 0.72 | 0.79 | 0.38 | 0.01 | 0.02 |
| svm~28 + 6 | 0.62 | 0.01 | 0.41 | 0.74 | 0.78 | 0.36 | 0.01 | 0.01 |
| rpart~18 + 22 | 0.61 | 0.01 | 0.37 | 0.84 | 0.84 | 0.38 | 0.00 | 0.32 |
| nb~4 + 22 | 0.62 | 0.01 | 0.38 | 0.84 | 0.84 | 0.38 | 0.00 | 0.00 |
| nb~4 + 24 | 0.62 | 0.01 | 0.26 | 0.90 | 0.85 | 0.35 | 0.00 | 0.00 |
| nb~8 + 6 | 0.62 | 0.01 | 0.41 | 0.81 | 0.83 | 0.38 | 0.01 | 0.24 |
| nb~13 + 32 | 0.62 | 0.01 | 0.50 | 0.67 | 0.77 | 0.38 | 0.06 | 0.02 |
| rpart~13 + 22 | 0.62 | 0.01 | 0.59 | 0.59 | 0.76 | 0.40 | 0.01 | 0.11 |
| rpart~16 + 28 | 0.62 | 0.01 | 0.45 | 0.71 | 0.77 | 0.37 | 0.05 | 0.06 |
| rf~29 + 22 | 0.62 | 0.01 | 0.56 | 0.67 | 0.79 | 0.41 | 0.00 | 0.06 |
| rpart~4 + 16 | 0.62 | 0.01 | 0.46 | 0.74 | 0.80 | 0.38 | 0.00 | 0.00 |
| rf~1 + 22 | 0.62 | 0.01 | 0.54 | 0.66 | 0.78 | 0.39 | 0.01 | 0.16 |
| svm~4 + 19 | 0.62 | 0.01 | 0.49 | 0.76 | 0.82 | 0.40 | 0.00 | 0.00 |
| nb~18 + 6 | 0.62 | 0.01 | 0.44 | 0.74 | 0.79 | 0.37 | 0.00 | 0.04 |
| nb~5 + 22 | 0.62 | 0.01 | 0.52 | 0.66 | 0.77 | 0.38 | 0.02 | 0.02 |
| knn~10 + 22 | 0.62 | 0.01 | 0.73 | 0.45 | 0.75 | 0.43 | 0.01 | 0.61 |
| rpart~4 + 8 | 0.62 | 0.01 | 0.50 | 0.69 | 0.78 | 0.38 | 0.01 | 0.14 |
| nb~16 + 13 | 0.62 | 0.01 | 0.42 | 0.69 | 0.75 | 0.35 | 0.21 | 0.64 |
| nb~4 + 33 | 0.62 | 0.01 | 0.29 | 0.91 | 0.88 | 0.37 | 0.00 | 0.05 |
| rf~13 + 26 | 0.62 | 0.01 | 0.45 | 0.67 | 0.75 | 0.36 | 0.03 | 0.46 |
| svm~18 + 8 | 0.62 | 0.01 | 0.48 | 0.69 | 0.78 | 0.38 | 0.03 | 0.44 |

TABLE 49-continued pairwise biomarkers from the 43 biomarker panel with significance for
Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| rf~7 + 18 | 0.62 | 0.01 | 0.55 | 0.55 | 0.73 | 0.36 | 0.20 | 0.52 |
| svm~38 + 6 | 0.62 | 0.01 | 0.46 | 0.76 | 0.81 | 0.39 | 0.00 | 0.18 |
| nb~25 + 6 | 0.62 | 0.01 | 0.41 | 0.84 | 0.85 | 0.39 | 0.00 | 0.03 |
| svm~32 + 6 | 0.62 | 0.01 | 0.36 | 0.81 | 0.81 | 0.36 | 0.00 | 0.02 |
| svm~16 + 13 | 0.62 | 0.01 | 0.40 | 0.69 | 0.74 | 0.34 | 0.36 | 0.81 |
| svm~4 + 9 | 0.62 | 0.01 | 0.39 | 0.79 | 0.81 | 0.37 | 0.00 | 0.15 |
| svm~7 + 6 | 0.62 | 0.01 | 0.52 | 0.71 | 0.80 | 0.40 | 0.00 | 0.42 |
| knn~15 + 41 | 0.61 | 0.01 | 0.56 | 0.64 | 0.77 | 0.40 | 0.02 | 0.46 |
| rf~18 + 28 | 0.62 | 0.01 | 0.56 | 0.64 | 0.77 | 0.40 | 0.00 | 0.06 |
| rpart~18 + 19 | 0.61 | 0.01 | 0.59 | 0.60 | 0.77 | 0.40 | 0.00 | 0.03 |
| nb~4 + 7 | 0.62 | 0.01 | 0.36 | 0.79 | 0.79 | 0.36 | 0.02 | 0.25 |
| svm~18 + 13 | 0.62 | 0.01 | 0.47 | 0.69 | 0.77 | 0.37 | 0.01 | 0.08 |
| rpart~21 + 22 | 0.61 | 0.01 | 0.46 | 0.66 | 0.75 | 0.36 | 0.08 | 0.52 |
| nb~37 + 6 | 0.62 | 0.01 | 0.48 | 0.72 | 0.79 | 0.39 | 0.00 | 0.21 |
| rf~18 + 38 | 0.62 | 0.01 | 0.45 | 0.79 | 0.83 | 0.39 | 0.00 | 0.72 |
| rf~8 + 22 | 0.62 | 0.01 | 0.54 | 0.64 | 0.77 | 0.39 | 0.01 | 0.21 |
| nb~4 + 2 | 0.62 | 0.01 | 0.40 | 0.74 | 0.77 | 0.36 | 0.04 | 0.53 |
| svm~39 + 32 | 0.62 | 0.01 | 0.32 | 0.86 | 0.84 | 0.36 | 0.02 | 0.01 |
| knn~16 + 38 | 0.61 | 0.01 | 0.77 | 0.45 | 0.75 | 0.46 | 0.00 | 0.97 |
| nb~2 + 6 | 0.62 | 0.01 | 0.46 | 0.74 | 0.80 | 0.38 | 0.01 | 0.99 |
| rf~4 + 12 | 0.62 | 0.01 | 0.52 | 0.60 | 0.74 | 0.36 | 0.07 | 0.03 |
| svm~4 + 13 | 0.62 | 0.01 | 0.33 | 0.90 | 0.88 | 0.38 | 0.00 | 0.00 |
| nb~5 + 32 | 0.62 | 0.01 | 0.58 | 0.62 | 0.77 | 0.40 | 0.07 | 0.08 |
| knn~12 + 16 | 0.61 | 0.01 | 0.43 | 0.78 | 0.81 | 0.38 | 0.00 | 0.04 |
| knn~4 + 6 | 0.61 | 0.01 | 0.42 | 0.76 | 0.79 | 0.37 | 0.01 | 0.01 |
| rf~9 + 19 | 0.62 | 0.01 | 0.58 | 0.64 | 0.78 | 0.41 | 0.00 | 0.00 |
| rf~18 + 6 | 0.62 | 0.01 | 0.49 | 0.64 | 0.75 | 0.36 | 0.09 | 0.48 |
| nb~4 + 8 | 0.62 | 0.01 | 0.25 | 0.90 | 0.84 | 0.35 | 0.00 | 0.02 |
| svm~12 + 6 | 0.62 | 0.01 | 0.45 | 0.76 | 0.81 | 0.39 | 0.00 | 0.02 |
| rpart~1 + 18 | 0.61 | 0.01 | 0.31 | 0.84 | 0.82 | 0.36 | 0.05 | 0.62 |
| rpart~18 + 28 | 0.61 | 0.01 | 0.41 | 0.79 | 0.82 | 0.38 | 0.00 | 0.25 |
| nb~19 + 6 | 0.62 | 0.01 | 0.38 | 0.79 | 0.80 | 0.37 | 0.01 | 0.01 |
| nb~13 + 28 | 0.62 | 0.01 | 0.43 | 0.74 | 0.79 | 0.37 | 0.02 | 0.00 |
| rpart~41 + 18 | 0.61 | 0.01 | 0.45 | 0.74 | 0.79 | 0.38 | 0.00 | 0.55 |
| rpart~18 + 21 | 0.61 | 0.01 | 0.55 | 0.60 | 0.76 | 0.38 | 0.03 | 0.89 |
| rf~4 + 34 | 0.61 | 0.01 | 0.68 | 0.47 | 0.74 | 0.40 | 0.04 | 0.03 |
| nb~22 + 6 | 0.61 | 0.01 | 0.46 | 0.74 | 0.80 | 0.38 | 0.00 | 0.02 |
| rf~12 + 31 | 0.61 | 0.01 | 0.53 | 0.57 | 0.73 | 0.35 | 0.03 | 0.05 |
| knn~4 + 12 | 0.61 | 0.01 | 0.27 | 0.79 | 0.74 | 0.33 | 0.12 | 0.06 |
| knn~4 + 5 | 0.61 | 0.01 | 0.72 | 0.43 | 0.74 | 0.41 | 0.07 | 0.34 |
| rpart~4 + 42 | 0.61 | 0.01 | 0.55 | 0.66 | 0.78 | 0.40 | 0.01 | 0.62 |
| svm~13 + 19 | 0.61 | 0.01 | 0.62 | 0.55 | 0.75 | 0.40 | 0.02 | 0.06 |
| nb~16 + 38 | 0.61 | 0.01 | 0.36 | 0.69 | 0.72 | 0.33 | 0.58 | 0.41 |
| nb~24 + 6 | 0.61 | 0.01 | 0.27 | 0.84 | 0.79 | 0.34 | 0.04 | 0.02 |
| knn~16 + 6 | 0.61 | 0.01 | 0.45 | 0.71 | 0.77 | 0.37 | 0.04 | 0.49 |
| nb~15 + 6 | 0.61 | 0.01 | 0.30 | 0.86 | 0.83 | 0.36 | 0.00 | 0.07 |
| nb~15 + 5 | 0.61 | 0.01 | 0.55 | 0.71 | 0.81 | 0.42 | 0.00 | 0.43 |
| svm~31 + 6 | 0.61 | 0.01 | 0.46 | 0.69 | 0.77 | 0.37 | 0.05 | 0.07 |
| nb~5 + 28 | 0.61 | 0.01 | 0.49 | 0.72 | 0.80 | 0.39 | 0.01 | 0.05 |
| rpart~39 + 22 | 0.61 | 0.01 | 0.53 | 0.62 | 0.76 | 0.38 | 0.03 | 0.01 |
| nb~4 + 19 | 0.61 | 0.01 | 0.36 | 0.84 | 0.84 | 0.37 | 0.00 | 0.00 |
| rf~4 + 16 | 0.61 | 0.01 | 0.55 | 0.60 | 0.76 | 0.38 | 0.05 | 0.00 |
| nb~7 + 22 | 0.61 | 0.01 | 0.51 | 0.67 | 0.77 | 0.38 | 0.02 | 0.57 |
| rpart~1 + 28 | 0.61 | 0.01 | 0.45 | 0.69 | 0.76 | 0.36 | 0.03 | 0.22 |
| rpart~15 + 33 | 0.61 | 0.01 | 0.27 | 0.93 | 0.89 | 0.36 | 0.00 | 0.03 |
| rf~35 + 5 | 0.61 | 0.01 | 0.58 | 0.59 | 0.76 | 0.39 | 0.09 | 0.83 |
| rpart~8 + 6 | 0.61 | 0.01 | 0.45 | 0.78 | 0.82 | 0.39 | 0.00 | 0.25 |
| rpart~18 + 26 | 0.61 | 0.01 | 0.26 | 0.83 | 0.77 | 0.34 | 0.08 | 0.38 |
| svm~8 + 6 | 0.61 | 0.01 | 0.46 | 0.76 | 0.81 | 0.39 | 0.00 | 0.54 |
| knn~9 + 22 | 0.61 | 0.01 | 0.45 | 0.71 | 0.77 | 0.37 | 0.02 | 0.15 |
| rf~5 + 19 | 0.61 | 0.01 | 0.55 | 0.62 | 0.76 | 0.38 | 0.03 | 0.03 |
| rpart~2 + 19 | 0.61 | 0.01 | 0.71 | 0.36 | 0.71 | 0.36 | 0.30 | 0.34 |
| nb~16 + 22 | 0.61 | 0.01 | 0.45 | 0.69 | 0.76 | 0.36 | 0.05 | 0.02 |
| nb~35 + 6 | 0.61 | 0.01 | 0.38 | 0.78 | 0.79 | 0.36 | 0.02 | 0.17 |
| svm~4 + 7 | 0.61 | 0.01 | 0.44 | 0.78 | 0.81 | 0.38 | 0.00 | 0.38 |
| svm~15 + 6 | 0.61 | 0.01 | 0.37 | 0.81 | 0.81 | 0.37 | 0.00 | 0.08 |
| knn~9 + 19 | 0.61 | 0.01 | 0.59 | 0.62 | 0.77 | 0.40 | 0.01 | 0.06 |
| rf~18 + 22 | 0.61 | 0.01 | 0.50 | 0.64 | 0.75 | 0.37 | 0.06 | 0.03 |
| nb~1 + 28 | 0.61 | 0.01 | 0.41 | 0.74 | 0.78 | 0.36 | 0.03 | 0.00 |
| nb~18 + 9 | 0.61 | 0.01 | 0.52 | 0.64 | 0.76 | 0.37 | 0.02 | 0.81 |
| knn~16 + 28 | 0.61 | 0.01 | 0.77 | 0.41 | 0.74 | 0.44 | 0.00 | 0.03 |
| nb~11 + 6 | 0.61 | 0.01 | 0.31 | 0.90 | 0.87 | 0.37 | 0.00 | 0.07 |
| svm~21 + 6 | 0.61 | 0.01 | 0.45 | 0.71 | 0.77 | 0.37 | 0.02 | 0.58 |

TABLE 49-continued pairwise biomarkers from the 43 biomarker panel with significance for
Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~4 + 18 | 0.61 | 0.02 | 0.37 | 0.78 | 0.78 | 0.36 | 0.01 | 0.01 |
| rf~4 + 7 | 0.61 | 0.02 | 0.51 | 0.64 | 0.76 | 0.37 | 0.05 | 0.45 |
| svm~13 + 22 | 0.61 | 0.02 | 0.49 | 0.71 | 0.79 | 0.39 | 0.00 | 0.16 |
| nb~4 + 38 | 0.61 | 0.02 | 0.38 | 0.74 | 0.76 | 0.35 | 0.07 | 0.67 |
| rf~26 + 22 | 0.61 | 0.02 | 0.49 | 0.69 | 0.78 | 0.38 | 0.00 | 0.04 |
| svm~41 + 6 | 0.61 | 0.02 | 0.49 | 0.71 | 0.79 | 0.39 | 0.01 | 0.07 |
| rf~39 + 32 | 0.61 | 0.02 | 0.59 | 0.60 | 0.77 | 0.40 | 0.01 | 0.00 |
| knn~29 + 6 | 0.61 | 0.02 | 0.44 | 0.72 | 0.78 | 0.37 | 0.02 | 0.04 |
| rpart~33 + 9 | 0.59 | 0.02 | 0.45 | 0.74 | 0.79 | 0.38 | 0.00 | 0.01 |
| svm~19 + 38 | 0.61 | 0.02 | 0.49 | 0.69 | 0.78 | 0.38 | 0.01 | 0.09 |
| rf~7 + 6 | 0.61 | 0.02 | 0.58 | 0.62 | 0.77 | 0.40 | 0.02 | 0.92 |
| svm~4 + 1 | 0.61 | 0.02 | 0.31 | 0.84 | 0.82 | 0.36 | 0.02 | 0.01 |
| svm~26 + 19 | 0.61 | 0.02 | 0.37 | 0.79 | 0.80 | 0.36 | 0.01 | 0.03 |
| nb~13 + 20 | 0.61 | 0.02 | 0.52 | 0.62 | 0.75 | 0.37 | 0.03 | 0.03 |
| nb~41 + 6 | 0.61 | 0.02 | 0.33 | 0.83 | 0.81 | 0.36 | 0.01 | 0.11 |
| rf~1 + 18 | 0.61 | 0.02 | 0.64 | 0.53 | 0.75 | 0.40 | 0.09 | 0.72 |
| rpart~15 + 3 | 0.61 | 0.02 | 0.34 | 0.76 | 0.75 | 0.34 | 0.27 | 0.10 |
| svm~4 + 28 | 0.61 | 0.02 | 0.38 | 0.78 | 0.79 | 0.36 | 0.01 | 0.00 |
| nb~34 + 6 | 0.61 | 0.02 | 0.43 | 0.76 | 0.80 | 0.38 | 0.01 | 0.19 |
| nb~32 + 22 | 0.61 | 0.02 | 0.48 | 0.64 | 0.74 | 0.36 | 0.09 | 0.01 |
| nb~4 + 41 | 0.61 | 0.02 | 0.31 | 0.83 | 0.80 | 0.35 | 0.01 | 0.03 |
| rf~5 + 22 | 0.61 | 0.02 | 0.59 | 0.59 | 0.76 | 0.39 | 0.07 | 0.05 |
| nb~10 + 6 | 0.61 | 0.02 | 0.30 | 0.86 | 0.83 | 0.36 | 0.01 | 0.23 |
| svm~3 + 28 | 0.61 | 0.02 | 0.26 | 0.84 | 0.79 | 0.34 | 0.04 | 0.01 |
| knn~40 + 28 | 0.61 | 0.02 | 0.37 | 0.86 | 0.85 | 0.38 | 0.00 | 0.25 |
| nb~1 + 18 | 0.61 | 0.02 | 0.34 | 0.74 | 0.75 | 0.34 | 0.25 | 0.17 |
| nb~18 + 22 | 0.61 | 0.02 | 0.55 | 0.66 | 0.78 | 0.40 | 0.00 | 0.01 |
| knn~37 + 6 | 0.61 | 0.02 | 0.65 | 0.43 | 0.72 | 0.36 | 0.22 | 0.63 |
| svm~9 + 22 | 0.61 | 0.02 | 0.38 | 0.78 | 0.79 | 0.36 | 0.01 | 0.29 |
| svm~16 + 38 | 0.61 | 0.02 | 0.36 | 0.74 | 0.75 | 0.34 | 0.18 | 0.40 |
| nb~13 + 26 | 0.61 | 0.02 | 0.61 | 0.52 | 0.74 | 0.38 | 0.12 | 0.10 |
| knn~13 + 6 | 0.61 | 0.02 | 0.67 | 0.50 | 0.75 | 0.41 | 0.02 | 0.31 |
| svm~7 + 22 | 0.61 | 0.02 | 0.52 | 0.67 | 0.78 | 0.39 | 0.01 | 0.66 |
| nb~4 + 20 | 0.61 | 0.02 | 0.41 | 0.76 | 0.79 | 0.37 | 0.00 | 0.01 |
| svm~34 + 6 | 0.61 | 0.02 | 0.51 | 0.64 | 0.76 | 0.37 | 0.02 | 0.16 |
| nb~1 + 16 | 0.61 | 0.02 | 0.37 | 0.72 | 0.75 | 0.34 | 0.44 | 0.51 |
| rf~4 + 9 | 0.61 | 0.02 | 0.48 | 0.66 | 0.75 | 0.36 | 0.02 | 0.03 |
| rpart~12 + 5 | 0.60 | 0.02 | 0.49 | 0.71 | 0.79 | 0.39 | 0.02 | 0.50 |
| rpart~18 + 8 | 0.60 | 0.02 | 0.48 | 0.74 | 0.81 | 0.39 | 0.00 | 0.86 |
| svm~2 + 6 | 0.61 | 0.02 | 0.52 | 0.64 | 0.76 | 0.38 | 0.02 | 0.98 |
| rpart~9 + 19 | 0.60 | 0.02 | 0.59 | 0.59 | 0.76 | 0.39 | 0.01 | 0.02 |
| svm~4 + 8 | 0.61 | 0.02 | 0.31 | 0.81 | 0.78 | 0.35 | 0.03 | 0.04 |
| rpart~31 + 22 | 0.60 | 0.02 | 0.45 | 0.72 | 0.78 | 0.38 | 0.01 | 0.03 |
| nb~4 + 15 | 0.61 | 0.02 | 0.32 | 0.83 | 0.80 | 0.36 | 0.00 | 0.01 |
| svm~10 + 6 | 0.61 | 0.02 | 0.36 | 0.81 | 0.81 | 0.36 | 0.00 | 0.18 |
| nb~18 + 32 | 0.61 | 0.02 | 0.41 | 0.72 | 0.77 | 0.36 | 0.02 | 0.02 |
| svm~4 + 38 | 0.61 | 0.02 | 0.35 | 0.78 | 0.78 | 0.35 | 0.02 | 0.16 |
| nb~4 + 25 | 0.61 | 0.02 | 0.38 | 0.83 | 0.83 | 0.38 | 0.00 | 0.00 |
| knn~30 + 6 | 0.60 | 0.02 | 0.50 | 0.62 | 0.74 | 0.36 | 0.12 | 0.14 |
| nb~15 + 16 | 0.61 | 0.02 | 0.33 | 0.71 | 0.71 | 0.32 | 0.56 | 0.59 |
| svm~2 + 28 | 0.61 | 0.02 | 0.52 | 0.59 | 0.74 | 0.36 | 0.07 | 0.21 |
| rpart~4 + 5 | 0.60 | 0.02 | 0.48 | 0.66 | 0.76 | 0.37 | 0.13 | 0.91 |
| nb~16 + 28 | 0.61 | 0.02 | 0.52 | 0.66 | 0.77 | 0.38 | 0.02 | 0.02 |
| svm~26 + 6 | 0.61 | 0.02 | 0.38 | 0.76 | 0.77 | 0.35 | 0.02 | 0.09 |
| svm~16 + 34 | 0.61 | 0.02 | 0.37 | 0.74 | 0.76 | 0.35 | 0.16 | 0.43 |
| rf~15 + 28 | 0.61 | 0.02 | 0.52 | 0.59 | 0.74 | 0.36 | 0.17 | 0.52 |
| nb~18 + 5 | 0.61 | 0.02 | 0.63 | 0.48 | 0.73 | 0.37 | 0.48 | 0.39 |
| rf~26 + 19 | 0.61 | 0.02 | 0.56 | 0.69 | 0.80 | 0.42 | 0.00 | 0.01 |
| rpart~28 + 22 | 0.60 | 0.02 | 0.48 | 0.67 | 0.77 | 0.37 | 0.01 | 0.00 |
| knn~12 + 6 | 0.60 | 0.02 | 0.46 | 0.76 | 0.81 | 0.39 | 0.00 | 0.02 |
| knn~28 + 21 | 0.60 | 0.02 | 0.70 | 0.41 | 0.73 | 0.39 | 0.11 | 0.11 |
| knn~36 + 6 | 0.60 | 0.02 | 0.48 | 0.67 | 0.76 | 0.37 | 0.04 | 0.01 |
| rf~19 + 22 | 0.60 | 0.02 | 0.35 | 0.72 | 0.74 | 0.34 | 0.19 | 0.00 |
| knn~13 + 21 | 0.60 | 0.02 | 0.73 | 0.45 | 0.75 | 0.43 | 0.05 | 0.21 |
| rpart~1 + 29 | 0.60 | 0.02 | 0.30 | 0.83 | 0.80 | 0.35 | 0.23 | 0.68 |
| rpart~26 + 22 | 0.60 | 0.02 | 0.38 | 0.79 | 0.80 | 0.37 | 0.00 | 0.01 |
| nb~1 + 15 | 0.60 | 0.02 | 0.37 | 0.71 | 0.73 | 0.34 | 0.54 | 0.37 |
| rpart~5 + 32 | 0.60 | 0.02 | 0.42 | 0.71 | 0.76 | 0.36 | 0.24 | 0.16 |
| rf~9 + 28 | 0.60 | 0.02 | 0.48 | 0.69 | 0.77 | 0.37 | 0.01 | 0.02 |
| svm~18 + 19 | 0.60 | 0.02 | 0.50 | 0.72 | 0.80 | 0.40 | 0.00 | 0.01 |
| nb~14 + 6 | 0.60 | 0.02 | 0.40 | 0.81 | 0.82 | 0.38 | 0.00 | 0.03 |
| knn~17 + 37 | 0.60 | 0.02 | 0.71 | 0.50 | 0.76 | 0.44 | 0.00 | 0.22 |
| nb~9 + 19 | 0.60 | 0.02 | 0.56 | 0.60 | 0.76 | 0.38 | 0.00 | 0.07 |

TABLE 49-continued pairwise biomarkers from the 43 biomarker panel with significance for
Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| rpart~20 + 28 | 0.60 | 0.02 | 0.63 | 0.50 | 0.73 | 0.38 | 0.03 | 0.00 |
| svm~15 + 13 | 0.60 | 0.02 | 0.40 | 0.76 | 0.78 | 0.36 | 0.01 | 0.15 |
| nb~17 + 6 | 0.60 | 0.02 | 0.48 | 0.67 | 0.76 | 0.37 | 0.02 | 0.01 |
| rf~38 + 28 | 0.60 | 0.02 | 0.52 | 0.62 | 0.75 | 0.37 | 0.07 | 0.05 |
| nb~16 + 32 | 0.60 | 0.02 | 0.39 | 0.71 | 0.75 | 0.34 | 0.19 | 0.12 |
| rf~4 + 22 | 0.60 | 0.02 | 0.59 | 0.60 | 0.77 | 0.40 | 0.00 | 0.00 |
| svm~16 + 22 | 0.60 | 0.02 | 0.47 | 0.60 | 0.72 | 0.34 | 0.23 | 0.09 |
| nb~28 + 22 | 0.60 | 0.02 | 0.46 | 0.67 | 0.76 | 0.36 | 0.02 | 0.00 |
| svm~41 + 38 | 0.60 | 0.02 | 0.34 | 0.76 | 0.75 | 0.34 | 0.33 | 0.78 |
| knn~19 + 22 | 0.60 | 0.02 | 0.70 | 0.38 | 0.71 | 0.37 | 0.31 | 0.01 |
| rpart~4 + 9 | 0.60 | 0.02 | 0.43 | 0.69 | 0.75 | 0.35 | 0.05 | 0.23 |
| nb~28 + 32 | 0.60 | 0.02 | 0.45 | 0.64 | 0.73 | 0.35 | 0.10 | 0.00 |
| svm~16 + 31 | 0.60 | 0.02 | 0.32 | 0.71 | 0.71 | 0.32 | 0.84 | 0.82 |
| knn~15 + 24 | 0.60 | 0.02 | 0.57 | 0.59 | 0.75 | 0.38 | 0.05 | 0.13 |
| rpart~4 + 34 | 0.60 | 0.02 | 0.53 | 0.64 | 0.76 | 0.38 | 0.01 | 0.10 |
| svm~7 + 19 | 0.60 | 0.02 | 0.59 | 0.59 | 0.76 | 0.40 | 0.01 | 0.47 |
| nb~1 + 19 | 0.60 | 0.02 | 0.70 | 0.45 | 0.74 | 0.41 | 0.05 | 0.00 |
| rpart~26 + 19 | 0.60 | 0.02 | 0.62 | 0.53 | 0.75 | 0.39 | 0.04 | 0.01 |
| rf~4 + 13 | 0.60 | 0.02 | 0.38 | 0.81 | 0.81 | 0.37 | 0.00 | 0.02 |
| rpart~16 + 18 | 0.58 | 0.02 | 0.30 | 0.90 | 0.86 | 0.37 | 0.00 | 0.37 |
| nb~18 + 28 | 0.60 | 0.02 | 0.42 | 0.64 | 0.72 | 0.33 | 0.21 | 0.01 |
| svm~4 + 29 | 0.60 | 0.03 | 0.28 | 0.84 | 0.80 | 0.35 | 0.00 | 0.03 |
| svm~1 + 18 | 0.60 | 0.03 | 0.35 | 0.81 | 0.80 | 0.36 | 0.02 | 0.90 |
| rf~25 + 28 | 0.60 | 0.03 | 0.45 | 0.59 | 0.70 | 0.32 | 0.85 | 0.01 |
| nb~24 + 22 | 0.60 | 0.03 | 0.51 | 0.62 | 0.75 | 0.36 | 0.05 | 0.00 |
| svm~1 + 19 | 0.60 | 0.03 | 0.49 | 0.64 | 0.75 | 0.36 | 0.04 | 0.05 |
| rf~8 + 19 | 0.60 | 0.03 | 0.35 | 0.72 | 0.74 | 0.34 | 0.25 | 0.04 |
| nb~2 + 22 | 0.60 | 0.03 | 0.46 | 0.64 | 0.74 | 0.35 | 0.16 | 0.73 |
| nb~12 + 6 | 0.60 | 0.03 | 0.51 | 0.67 | 0.77 | 0.38 | 0.01 | 0.02 |
| svm~39 + 6 | 0.60 | 0.03 | 0.40 | 0.81 | 0.82 | 0.38 | 0.00 | 0.11 |
| rpart~4 + 13 | 0.60 | 0.03 | 0.44 | 0.72 | 0.78 | 0.37 | 0.01 | 0.00 |
| rpart~5 + 20 | 0.60 | 0.03 | 0.57 | 0.55 | 0.74 | 0.37 | 0.05 | 0.16 |
| svm~4 + 22 | 0.60 | 0.03 | 0.42 | 0.83 | 0.84 | 0.39 | 0.00 | 0.00 |
| svm~25 + 6 | 0.60 | 0.03 | 0.54 | 0.62 | 0.76 | 0.38 | 0.02 | 0.11 |
| rpart~22 + 6 | 0.60 | 0.03 | 0.41 | 0.74 | 0.78 | 0.36 | 0.04 | 0.02 |
| knn~4 + 1 | 0.60 | 0.03 | 0.70 | 0.41 | 0.73 | 0.39 | 0.19 | 0.04 |
| rpart~7 + 20 | 0.60 | 0.03 | 0.65 | 0.50 | 0.74 | 0.39 | 0.03 | 0.88 |
| nb~18 + 2 | 0.60 | 0.03 | 0.41 | 0.69 | 0.74 | 0.34 | 0.19 | 0.23 |
| knn~17 + 22 | 0.60 | 0.03 | 0.45 | 0.66 | 0.74 | 0.35 | 0.03 | 0.01 |
| knn~19 + 28 | 0.60 | 0.03 | 0.52 | 0.59 | 0.74 | 0.36 | 0.07 | 0.03 |
| rpart~20 + 22 | 0.60 | 0.03 | 0.42 | 0.72 | 0.77 | 0.36 | 0.02 | 0.01 |
| svm~39 + 22 | 0.60 | 0.03 | 0.52 | 0.62 | 0.75 | 0.37 | 0.04 | 0.02 |
| knn~22 + 6 | 0.60 | 0.03 | 0.66 | 0.50 | 0.75 | 0.40 | 0.03 | 0.06 |
| rpart~14 + 22 | 0.60 | 0.03 | 0.38 | 0.83 | 0.83 | 0.38 | 0.00 | 0.02 |
| rpart~24 + 5 | 0.60 | 0.03 | 0.38 | 0.76 | 0.78 | 0.36 | 0.08 | 0.02 |
| rf~16 + 38 | 0.60 | 0.03 | 0.52 | 0.66 | 0.77 | 0.38 | 0.01 | 0.69 |
| svm~8 + 28 | 0.60 | 0.03 | 0.45 | 0.66 | 0.74 | 0.35 | 0.07 | 0.01 |
| svm~4 + 32 | 0.60 | 0.03 | 0.38 | 0.76 | 0.78 | 0.36 | 0.01 | 0.00 |
| nb~20 + 6 | 0.60 | 0.03 | 0.44 | 0.67 | 0.75 | 0.35 | 0.05 | 0.03 |
| rpart~1 + 20 | 0.60 | 0.03 | 0.66 | 0.50 | 0.75 | 0.40 | 0.03 | 0.01 |
| knn~24 + 13 | 0.60 | 0.03 | 0.58 | 0.53 | 0.73 | 0.36 | 0.07 | 0.03 |
| rpart~41 + 28 | 0.60 | 0.03 | 0.38 | 0.78 | 0.79 | 0.36 | 0.00 | 0.00 |
| svm~8 + 22 | 0.60 | 0.03 | 0.41 | 0.76 | 0.79 | 0.37 | 0.01 | 0.14 |
| rf~16 + 28 | 0.60 | 0.03 | 0.47 | 0.67 | 0.76 | 0.36 | 0.08 | 0.12 |
| nb~4 + 37 | 0.60 | 0.03 | 0.34 | 0.83 | 0.81 | 0.36 | 0.00 | 0.05 |
| svm~28 + 21 | 0.60 | 0.03 | 0.40 | 0.76 | 0.78 | 0.36 | 0.00 | 0.06 |
| nb~1 + 32 | 0.60 | 0.03 | 0.40 | 0.66 | 0.72 | 0.33 | 0.58 | 0.01 |
| rpart~32 + 22 | 0.60 | 0.03 | 0.39 | 0.78 | 0.79 | 0.37 | 0.00 | 0.02 |
| knn~42 + 19 | 0.60 | 0.03 | 0.61 | 0.59 | 0.76 | 0.40 | 0.01 | 0.02 |
| knn~15 + 13 | 0.60 | 0.03 | 0.61 | 0.50 | 0.73 | 0.37 | 0.16 | 0.20 |
| svm~13 + 26 | 0.60 | 0.03 | 0.27 | 0.90 | 0.85 | 0.36 | 0.00 | 0.05 |
| rf~16 + 3 | 0.60 | 0.03 | 0.32 | 0.81 | 0.79 | 0.35 | 0.07 | 0.00 |
| svm~16 + 28 | 0.60 | 0.03 | 0.43 | 0.84 | 0.86 | 0.40 | 0.00 | 0.01 |
| nb~36 + 22 | 0.60 | 0.03 | 0.53 | 0.57 | 0.73 | 0.35 | 0.08 | 0.02 |
| svm~24 + 5 | 0.60 | 0.03 | 0.30 | 0.84 | 0.81 | 0.36 | 0.04 | 0.02 |
| nb~15 + 22 | 0.60 | 0.03 | 0.36 | 0.81 | 0.81 | 0.36 | 0.00 | 0.03 |
| svm~4 + 18 | 0.60 | 0.03 | 0.32 | 0.78 | 0.76 | 0.34 | 0.05 | 0.03 |
| svm~19 + 22 | 0.60 | 0.03 | 0.40 | 0.74 | 0.77 | 0.36 | 0.03 | 0.01 |
| nb~15 + 28 | 0.60 | 0.03 | 0.34 | 0.81 | 0.80 | 0.36 | 0.00 | 0.01 |
| nb~37 + 22 | 0.60 | 0.03 | 0.48 | 0.60 | 0.73 | 0.35 | 0.10 | 0.10 |
| svm~33 + 6 | 0.60 | 0.03 | 0.41 | 0.69 | 0.75 | 0.35 | 0.20 | 0.27 |
| svm~16 + 41 | 0.60 | 0.03 | 0.30 | 0.72 | 0.71 | 0.32 | 0.77 | 0.87 |
| nb~21 + 6 | 0.60 | 0.03 | 0.42 | 0.76 | 0.79 | 0.37 | 0.01 | 0.34 |

TABLE 49-continued pairwise biomarkers from the 43 biomarker panel with significance for
Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~24 + 5 | 0.60 | 0.03 | 0.59 | 0.60 | 0.77 | 0.40 | 0.06 | 0.06 |
| knn~1 + 18 | 0.60 | 0.03 | 0.70 | 0.43 | 0.73 | 0.40 | 0.09 | 0.61 |
| nb~4 + 29 | 0.60 | 0.03 | 0.36 | 0.74 | 0.75 | 0.34 | 0.06 | 0.13 |
| svm~16 + 10 | 0.60 | 0.03 | 0.53 | 0.62 | 0.76 | 0.38 | 0.08 | 0.67 |
| nb~23 + 6 | 0.60 | 0.03 | 0.39 | 0.78 | 0.79 | 0.37 | 0.03 | 0.82 |
| svm~16 + 19 | 0.60 | 0.03 | 0.47 | 0.62 | 0.73 | 0.35 | 0.26 | 0.18 |
| rpart~4 + 41 | 0.60 | 0.03 | 0.33 | 0.84 | 0.82 | 0.36 | 0.00 | 0.20 |
| rf~12 + 22 | 0.60 | 0.03 | 0.45 | 0.71 | 0.77 | 0.37 | 0.00 | 0.00 |
| rf~20 + 6 | 0.60 | 0.03 | 0.51 | 0.62 | 0.75 | 0.36 | 0.11 | 0.25 |
| nb~4 + 17 | 0.60 | 0.03 | 0.33 | 0.83 | 0.81 | 0.36 | 0.00 | 0.00 |
| svm~4 + 27 | 0.60 | 0.03 | 0.38 | 0.74 | 0.77 | 0.35 | 0.00 | 0.01 |
| knn~26 + 22 | 0.59 | 0.03 | 0.64 | 0.52 | 0.75 | 0.39 | 0.03 | 0.02 |
| nb~16 + 2 | 0.60 | 0.03 | 0.49 | 0.69 | 0.78 | 0.38 | 0.03 | 0.14 |
| svm~1 + 22 | 0.60 | 0.03 | 0.38 | 0.79 | 0.80 | 0.37 | 0.01 | 0.05 |
| rf~9 + 6 | 0.60 | 0.03 | 0.45 | 0.66 | 0.74 | 0.35 | 0.07 | 0.20 |
| rpart~24 + 19 | 0.59 | 0.03 | 0.52 | 0.62 | 0.75 | 0.37 | 0.04 | 0.00 |
| nb~16 + 20 | 0.60 | 0.03 | 0.57 | 0.53 | 0.73 | 0.36 | 0.05 | 0.06 |
| rpart~1 + 21 | 0.60 | 0.03 | 0.36 | 0.76 | 0.77 | 0.35 | 0.20 | 0.27 |
| nb~38 + 6 | 0.60 | 0.03 | 0.39 | 0.76 | 0.78 | 0.36 | 0.04 | 0.99 |
| nb~16 + 41 | 0.60 | 0.03 | 0.32 | 0.72 | 0.72 | 0.33 | 0.56 | 0.74 |
| nb~4 + 14 | 0.60 | 0.03 | 0.26 | 0.88 | 0.83 | 0.35 | 0.00 | 0.01 |
| rpart~42 + 22 | 0.59 | 0.03 | 0.49 | 0.60 | 0.73 | 0.35 | 0.07 | 0.09 |
| nb~2 + 28 | 0.60 | 0.03 | 0.44 | 0.67 | 0.75 | 0.35 | 0.05 | 0.51 |
| nb~4 + 11 | 0.60 | 0.03 | 0.23 | 0.93 | 0.88 | 0.35 | 0.00 | 0.01 |
| nb~4 + 35 | 0.60 | 0.03 | 0.30 | 0.88 | 0.84 | 0.36 | 0.00 | 0.05 |
| rpart~19 + 3 | 0.59 | 0.04 | 0.47 | 0.72 | 0.79 | 0.38 | 0.00 | 0.01 |
| nb~5 + 2 | 0.60 | 0.04 | 0.38 | 0.86 | 0.86 | 0.38 | 0.00 | 0.31 |
| svm~12 + 5 | 0.60 | 0.04 | 0.52 | 0.62 | 0.75 | 0.37 | 0.07 | 0.28 |
| nb~35 + 5 | 0.60 | 0.04 | 0.64 | 0.53 | 0.75 | 0.40 | 0.09 | 0.77 |
| rpart~20 + 34 | 0.59 | 0.04 | 0.59 | 0.53 | 0.74 | 0.37 | 0.10 | 0.03 |
| knn~1 + 28 | 0.59 | 0.04 | 0.73 | 0.40 | 0.73 | 0.40 | 0.08 | 0.23 |
| rf~41 + 20 | 0.60 | 0.04 | 0.52 | 0.66 | 0.77 | 0.38 | 0.02 | 0.03 |
| nb~19 + 22 | 0.60 | 0.04 | 0.59 | 0.59 | 0.76 | 0.39 | 0.01 | 0.00 |
| rpart~18 + 9 | 0.58 | 0.04 | 0.38 | 0.81 | 0.82 | 0.37 | 0.00 | 0.86 |
| rpart~15 + 3 | 0.59 | 0.04 | 0.20 | 0.88 | 0.78 | 0.33 | 0.13 | 0.18 |
| nb~8 + 22 | 0.60 | 0.04 | 0.55 | 0.60 | 0.75 | 0.38 | 0.06 | 0.10 |
| nb~19 + 32 | 0.60 | 0.04 | 0.41 | 0.72 | 0.76 | 0.36 | 0.04 | 0.00 |
| svm~17 + 6 | 0.60 | 0.04 | 0.39 | 0.72 | 0.76 | 0.35 | 0.05 | 0.04 |
| rpart~16 + 22 | 0.59 | 0.04 | 0.49 | 0.67 | 0.77 | 0.38 | 0.02 | 0.18 |
| svm~31 + 19 | 0.60 | 0.04 | 0.52 | 0.66 | 0.77 | 0.38 | 0.01 | 0.00 |
| rpart~5 + 19 | 0.59 | 0.04 | 0.66 | 0.53 | 0.76 | 0.42 | 0.00 | 0.01 |
| knn~41 + 19 | 0.59 | 0.04 | 0.73 | 0.40 | 0.73 | 0.40 | 0.02 | 0.00 |
| nb~41 + 28 | 0.60 | 0.04 | 0.48 | 0.60 | 0.73 | 0.35 | 0.13 | 0.01 |
| svm~15 + 22 | 0.60 | 0.04 | 0.34 | 0.84 | 0.83 | 0.37 | 0.00 | 0.05 |
| rf~35 + 6 | 0.60 | 0.04 | 0.52 | 0.57 | 0.73 | 0.35 | 0.28 | 0.89 |
| rpart~1 + 6 | 0.59 | 0.04 | 0.47 | 0.66 | 0.75 | 0.36 | 0.07 | 0.79 |
| rf~17 + 9 | 0.60 | 0.04 | 0.49 | 0.67 | 0.77 | 0.38 | 0.04 | 0.17 |
| nb~15 + 9 | 0.60 | 0.04 | 0.46 | 0.67 | 0.76 | 0.36 | 0.03 | 0.90 |
| nb~26 + 6 | 0.60 | 0.04 | 0.45 | 0.72 | 0.78 | 0.37 | 0.01 | 0.05 |
| rpart~15 + 20 | 0.59 | 0.04 | 0.52 | 0.66 | 0.77 | 0.38 | 0.00 | 0.13 |
| rpart~1 + 19 | 0.59 | 0.04 | 0.54 | 0.64 | 0.77 | 0.39 | 0.03 | 0.00 |
| knn~35 + 6 | 0.59 | 0.04 | 0.58 | 0.57 | 0.75 | 0.38 | 0.10 | 0.36 |
| knn~35 + 5 | 0.59 | 0.04 | 0.45 | 0.72 | 0.78 | 0.37 | 0.09 | 0.81 |
| rf~9 + 22 | 0.60 | 0.04 | 0.42 | 0.71 | 0.76 | 0.36 | 0.05 | 0.08 |
| rpart~39 + 28 | 0.59 | 0.04 | 0.50 | 0.69 | 0.78 | 0.38 | 0.00 | 0.00 |
| knn~24 + 8 | 0.59 | 0.04 | 0.52 | 0.62 | 0.75 | 0.37 | 0.06 | 0.13 |
| rf~38 + 22 | 0.59 | 0.04 | 0.48 | 0.69 | 0.78 | 0.38 | 0.00 | 0.14 |
| nb~16 + 11 | 0.59 | 0.04 | 0.42 | 0.64 | 0.72 | 0.33 | 0.44 | 0.80 |
| svm~29 + 28 | 0.59 | 0.04 | 0.32 | 0.76 | 0.75 | 0.34 | 0.12 | 0.02 |
| knn~39 + 32 | 0.59 | 0.04 | 0.67 | 0.48 | 0.74 | 0.40 | 0.10 | 0.00 |
| knn~24 + 22 | 0.59 | 0.04 | 0.37 | 0.78 | 0.78 | 0.36 | 0.02 | 0.06 |
| knn~4 + 36 | 0.59 | 0.04 | 0.69 | 0.40 | 0.72 | 0.37 | 0.09 | 0.07 |
| knn~16 + 22 | 0.59 | 0.04 | 0.51 | 0.69 | 0.78 | 0.39 | 0.00 | 0.18 |
| knn~16 + 3 | 0.59 | 0.04 | 0.62 | 0.57 | 0.76 | 0.40 | 0.04 | 0.02 |
| rpart~18 + 38 | 0.59 | 0.04 | 0.55 | 0.60 | 0.75 | 0.38 | 0.05 | 0.22 |
| nb~36 + 19 | 0.59 | 0.04 | 0.63 | 0.62 | 0.78 | 0.43 | 0.00 | 0.01 |
| svm~16 + 32 | 0.59 | 0.04 | 0.30 | 0.79 | 0.76 | 0.34 | 0.10 | 0.13 |
| knn~24 + 6 | 0.59 | 0.04 | 0.63 | 0.48 | 0.73 | 0.37 | 0.17 | 0.07 |
| rpart~4 + 7 | 0.59 | 0.04 | 0.48 | 0.67 | 0.77 | 0.37 | 0.05 | 0.92 |
| nb~25 + 22 | 0.59 | 0.04 | 0.48 | 0.72 | 0.79 | 0.39 | 0.00 | 0.01 |
| knn~40 + 13 | 0.59 | 0.04 | 0.62 | 0.55 | 0.75 | 0.40 | 0.03 | 0.23 |
| svm~39 + 19 | 0.59 | 0.04 | 0.54 | 0.64 | 0.77 | 0.39 | 0.00 | 0.00 |
| nb~3 + 6 | 0.59 | 0.04 | 0.27 | 0.86 | 0.81 | 0.35 | 0.02 | 0.05 |

TABLE 49-continued pairwise biomarkers from the 43 biomarker panel with significance for
Wilcoxon P-value (auc.pvalue <= 0.05) and other metrics for the BCR event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| rpart~4 + 14 | 0.59 | 0.04 | 0.37 | 0.76 | 0.77 | 0.35 | 0.02 | 0.19 |
| nb~18 + 8 | 0.59 | 0.04 | 0.41 | 0.72 | 0.77 | 0.36 | 0.06 | 0.86 |
| svm~33 + 28 | 0.59 | 0.04 | 0.52 | 0.57 | 0.73 | 0.35 | 0.27 | 0.02 |
| rf~20 + 22 | 0.59 | 0.04 | 0.43 | 0.69 | 0.75 | 0.35 | 0.07 | 0.04 |
| nb~41 + 22 | 0.59 | 0.04 | 0.49 | 0.64 | 0.75 | 0.36 | 0.04 | 0.06 |
| knn~37 + 20 | 0.59 | 0.04 | 0.36 | 0.81 | 0.81 | 0.36 | 0.00 | 0.15 |
| knn~15 + 39 | 0.59 | 0.04 | 0.55 | 0.60 | 0.75 | 0.38 | 0.07 | 0.85 |
| svm~2 + 22 | 0.59 | 0.04 | 0.57 | 0.52 | 0.72 | 0.35 | 0.16 | 0.41 |
| nb~29 + 6 | 0.59 | 0.04 | 0.38 | 0.78 | 0.79 | 0.36 | 0.01 | 0.27 |
| rf~31 + 19 | 0.59 | 0.04 | 0.56 | 0.52 | 0.72 | 0.35 | 0.20 | 0.02 |
| nb~9 + 28 | 0.59 | 0.04 | 0.41 | 0.74 | 0.78 | 0.36 | 0.01 | 0.05 |
| rf~29 + 19 | 0.59 | 0.04 | 0.54 | 0.59 | 0.74 | 0.37 | 0.02 | 0.00 |
| svm~41 + 22 | 0.59 | 0.04 | 0.45 | 0.67 | 0.75 | 0.35 | 0.07 | 0.12 |
| knn~15 + 3 | 0.59 | 0.04 | 0.46 | 0.64 | 0.74 | 0.35 | 0.25 | 0.11 |
| nb~18 + 36 | 0.59 | 0.04 | 0.48 | 0.59 | 0.72 | 0.34 | 0.23 | 0.43 |
| knn~4 + 42 | 0.59 | 0.04 | 0.76 | 0.29 | 0.70 | 0.35 | 0.27 | 0.04 |
| svm~29 + 19 | 0.59 | 0.04 | 0.45 | 0.74 | 0.79 | 0.38 | 0.01 | 0.02 |
| knn~39 + 19 | 0.59 | 0.04 | 0.54 | 0.66 | 0.78 | 0.39 | 0.01 | 0.00 |
| nb~15 + 18 | 0.59 | 0.04 | 0.39 | 0.74 | 0.77 | 0.36 | 0.01 | 0.28 |
| nb~7 + 28 | 0.59 | 0.04 | 0.45 | 0.71 | 0.77 | 0.37 | 0.01 | 0.41 |
| rpart~1 + 22 | 0.59 | 0.04 | 0.30 | 0.86 | 0.83 | 0.36 | 0.01 | 0.09 |
| rpart~25 + 22 | 0.59 | 0.04 | 0.56 | 0.50 | 0.71 | 0.34 | 0.34 | 0.13 |
| rf~24 + 6 | 0.59 | 0.04 | 0.56 | 0.55 | 0.73 | 0.36 | 0.15 | 0.10 |
| svm~4 + 34 | 0.59 | 0.04 | 0.36 | 0.74 | 0.75 | 0.34 | 0.05 | 0.01 |
| rf~38 + 6 | 0.59 | 0.04 | 0.52 | 0.66 | 0.77 | 0.38 | 0.02 | 0.08 |
| knn~5 + 32 | 0.59 | 0.05 | 0.70 | 0.45 | 0.74 | 0.40 | 0.04 | 0.08 |
| svm~28 + 22 | 0.59 | 0.05 | 0.39 | 0.78 | 0.79 | 0.37 | 0.01 | 0.00 |
| rpart~16 + 6 | 0.59 | 0.05 | 0.40 | 0.71 | 0.75 | 0.35 | 0.06 | 0.44 |
| knn~4 + 20 | 0.59 | 0.05 | 0.56 | 0.57 | 0.74 | 0.37 | 0.01 | 0.03 |
| nb~4 + 12 | 0.59 | 0.05 | 0.34 | 0.79 | 0.78 | 0.35 | 0.02 | 0.00 |
| svm~4 + 42 | 0.59 | 0.05 | 0.49 | 0.72 | 0.80 | 0.39 | 0.00 | 0.01 |
| rf~12 + 18 | 0.59 | 0.05 | 0.42 | 0.72 | 0.77 | 0.36 | 0.04 | 0.26 |
| rpart~10 + 22 | 0.59 | 0.05 | 0.44 | 0.72 | 0.78 | 0.37 | 0.01 | 0.03 |
| svm~35 + 19 | 0.59 | 0.05 | 0.42 | 0.74 | 0.78 | 0.37 | 0.03 | 0.05 |
| knn~18 + 32 | 0.59 | 0.05 | 0.72 | 0.45 | 0.74 | 0.42 | 0.02 | 0.07 |
| rpart~17 + 22 | 0.59 | 0.05 | 0.44 | 0.69 | 0.76 | 0.36 | 0.04 | 0.27 |
| rpart~15 + 9 | 0.58 | 0.05 | 0.31 | 0.79 | 0.77 | 0.34 | 0.05 | 0.74 |
| knn~4 + 34 | 0.59 | 0.05 | 0.67 | 0.40 | 0.71 | 0.35 | 0.22 | 0.01 |
| knn~14 + 32 | 0.59 | 0.05 | 0.63 | 0.52 | 0.74 | 0.39 | 0.01 | 0.01 |
| rpart~35 + 31 | 0.58 | 0.05 | 0.32 | 0.83 | 0.80 | 0.36 | 0.05 | 0.72 |
| rf~1 + 28 | 0.59 | 0.05 | 0.52 | 0.62 | 0.75 | 0.37 | 0.09 | 0.39 |
| svm~36 + 19 | 0.59 | 0.05 | 0.45 | 0.67 | 0.75 | 0.36 | 0.03 | 0.02 |
| rpart~9 + 20 | 0.59 | 0.05 | 0.62 | 0.50 | 0.73 | 0.37 | 0.06 | 0.18 |
| rf~26 + 28 | 0.59 | 0.05 | 0.54 | 0.57 | 0.73 | 0.36 | 0.02 | 0.01 |
| knn~16 + 10 | 0.59 | 0.05 | 0.70 | 0.43 | 0.73 | 0.40 | 0.07 | 0.49 |
| knn~42 + 18 | 0.59 | 0.05 | 0.52 | 0.59 | 0.73 | 0.35 | 0.24 | 0.68 |
| rpart~9 + 22 | 0.58 | 0.05 | 0.39 | 0.79 | 0.81 | 0.37 | 0.00 | 0.17 |
| rpart~4 + 6 | 0.59 | 0.05 | 0.43 | 0.67 | 0.74 | 0.35 | 0.14 | 0.13 |
| rf~41 + 18 | 0.59 | 0.05 | 0.41 | 0.74 | 0.78 | 0.36 | 0.04 | 0.53 |
| rf~18 + 37 | 0.59 | 0.05 | 0.38 | 0.78 | 0.79 | 0.36 | 0.03 | 0.91 |
| svm~4 + 31 | 0.59 | 0.05 | 0.41 | 0.66 | 0.73 | 0.34 | 0.19 | 0.00 |
| rpart~39 + 6 | 0.59 | 0.05 | 0.45 | 0.76 | 0.80 | 0.38 | 0.00 | 0.10 |
| knn~18 + 8 | 0.59 | 0.05 | 0.46 | 0.69 | 0.77 | 0.37 | 0.02 | 0.84 |
| svm~39 + 28 | 0.59 | 0.05 | 0.45 | 0.71 | 0.77 | 0.37 | 0.01 | 0.00 |
| nb~11 + 22 | 0.59 | 0.05 | 0.59 | 0.55 | 0.75 | 0.38 | 0.03 | 0.03 |
| rf~3 + 28 | 0.59 | 0.05 | 0.44 | 0.71 | 0.77 | 0.36 | 0.02 | 0.00 |
| nb~39 + 6 | 0.59 | 0.05 | 0.39 | 0.71 | 0.75 | 0.34 | 0.10 | 0.10 |
| nb~5 + 20 | 0.59 | 0.05 | 0.60 | 0.55 | 0.75 | 0.39 | 0.07 | 0.23 | auc.pvalue: Wilcoxon Test P-value.
mfd: Median Fold Difference.
KM: Kaplan Meier curves.
MvaHRPval: Multivariable Analysis Hazard Ratio P-value.

TABLE 50 pairwise biomarkers from the 43 biomarker panel with significance for
Wilcoxon P-value (auc.pvalue <= 0.001*) and other metrics for the MET
event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~4 + 16 | 0.747 | 0.000 | 0.471 | 0.890 | 0.711 | 0.745 | 0.000 | 0.000 |
| svm~4 + 16 | 0.741 | 0.000 | 0.544 | 0.763 | 0.569 | 0.744 | 0.000 | 0.001 |
| nb~4 + 35 | 0.726 | 0.000 | 0.471 | 0.890 | 0.711 | 0.745 | 0.000 | 0.002 |
| nb~16 + 6 | 0.725 | 0.000 | 0.574 | 0.746 | 0.565 | 0.752 | 0.000 | 0.001 |
| nb~4 + 15 | 0.725 | 0.000 | 0.471 | 0.839 | 0.627 | 0.733 | 0.000 | 0.000 |
| rpart~4 + 16 | 0.719 | 0.000 | 0.588 | 0.712 | 0.541 | 0.750 | 0.000 | 0.002 |
| nb~15 + 16 | 0.724 | 0.000 | 0.471 | 0.771 | 0.542 | 0.717 | 0.000 | 0.005 |
| nb~4 + 8 | 0.721 | 0.000 | 0.397 | 0.907 | 0.711 | 0.723 | 0.000 | 0.000 |
| svm~4 + 8 | 0.718 | 0.000 | 0.441 | 0.822 | 0.588 | 0.719 | 0.000 | 0.000 |
| nb~4 + 13 | 0.718 | 0.000 | 0.397 | 0.907 | 0.711 | 0.723 | 0.000 | 0.000 |
| svm~35 + 19 | 0.717 | 0.000 | 0.544 | 0.729 | 0.536 | 0.735 | 0.000 | 0.001 |
| nb~35 + 6 | 0.716 | 0.000 | 0.515 | 0.780 | 0.574 | 0.736 | 0.000 | 0.006 |
| knn~4 + 16 | 0.711 | 0.000 | 0.735 | 0.669 | 0.562 | 0.814 | 0.000 | 0.000 |
| nb~16 + 22 | 0.714 | 0.000 | 0.588 | 0.695 | 0.526 | 0.745 | 0.000 | 0.000 |
| nb~15 + 24 | 0.714 | 0.000 | 0.500 | 0.763 | 0.548 | 0.726 | 0.000 | 0.001 |
| svm~16 + 18 | 0.714 | 0.000 | 0.574 | 0.754 | 0.574 | 0.754 | 0.000 | 0.001 |
| nb~16 + 19 | 0.713 | 0.000 | 0.662 | 0.678 | 0.542 | 0.777 | 0.000 | 0.000 |
| nb~4 + 24 | 0.713 | 0.000 | 0.412 | 0.907 | 0.718 | 0.728 | 0.000 | 0.000 |
| nb~16 + 18 | 0.712 | 0.000 | 0.647 | 0.669 | 0.530 | 0.767 | 0.000 | 0.001 |
| svm~15 + 13 | 0.711 | 0.000 | 0.529 | 0.754 | 0.554 | 0.736 | 0.000 | 0.021 |
| svm~16 + 19 | 0.711 | 0.000 | 0.618 | 0.661 | 0.512 | 0.750 | 0.000 | 0.001 |
| nb~16 + 20 | 0.710 | 0.000 | 0.706 | 0.559 | 0.480 | 0.767 | 0.000 | 0.000 |
| nb~15 + 28 | 0.710 | 0.000 | 0.471 | 0.805 | 0.582 | 0.725 | 0.000 | 0.002 |
| svm~16 + 22 | 0.710 | 0.000 | 0.574 | 0.627 | 0.470 | 0.718 | 0.003 | 0.003 |
| nb~35 + 19 | 0.710 | 0.000 | 0.765 | 0.602 | 0.525 | 0.816 | 0.000 | 0.001 |
| nb~15 + 8 | 0.709 | 0.000 | 0.441 | 0.822 | 0.588 | 0.719 | 0.000 | 0.046 |
| svm~19 + 28 | 0.708 | 0.000 | 0.559 | 0.737 | 0.551 | 0.744 | 0.000 | 0.001 |
| svm~4 + 29 | 0.707 | 0.000 | 0.426 | 0.864 | 0.644 | 0.723 | 0.000 | 0.000 |
| svm~13 + 22 | 0.706 | 0.000 | 0.618 | 0.678 | 0.525 | 0.755 | 0.000 | 0.003 |
| rpart~15 + 33 | 0.697 | 0.000 | 0.338 | 0.873 | 0.605 | 0.696 | 0.000 | 0.121 |
| nb~15 + 13 | 0.705 | 0.000 | 0.574 | 0.712 | 0.534 | 0.743 | 0.000 | 0.034 |
| svm~31 + 19 | 0.705 | 0.000 | 0.662 | 0.653 | 0.523 | 0.770 | 0.000 | 0.000 |
| svm~15 + 8 | 0.704 | 0.000 | 0.397 | 0.831 | 0.574 | 0.705 | 0.000 | 0.065 |
| nb~35 + 22 | 0.704 | 0.000 | 0.750 | 0.525 | 0.477 | 0.785 | 0.000 | 0.007 |
| svm~16 + 6 | 0.703 | 0.000 | 0.603 | 0.695 | 0.532 | 0.752 | 0.000 | 0.001 |
| nb~4 + 1 | 0.703 | 0.000 | 0.500 | 0.839 | 0.642 | 0.744 | 0.000 | 0.000 |
| svm~4 + 41 | 0.703 | 0.000 | 0.353 | 0.847 | 0.571 | 0.694 | 0.001 | 0.001 |
| rpart~4 + 1 | 0.697 | 0.000 | 0.691 | 0.559 | 0.475 | 0.759 | 0.001 | 0.004 |
| svm~4 + 31 | 0.702 | 0.000 | 0.574 | 0.712 | 0.534 | 0.743 | 0.000 | 0.000 |
| nb~13 + 6 | 0.702 | 0.000 | 0.603 | 0.729 | 0.562 | 0.761 | 0.000 | 0.001 |
| nb~4 + 12 | 0.702 | 0.000 | 0.500 | 0.822 | 0.618 | 0.740 | 0.000 | 0.000 |
| nb~15 + 35 | 0.702 | 0.000 | 0.574 | 0.746 | 0.565 | 0.752 | 0.000 | 0.183 |
| nb~4 + 2 | 0.701 | 0.000 | 0.559 | 0.763 | 0.576 | 0.750 | 0.000 | 0.056 |
| svm~15 + 16 | 0.701 | 0.000 | 0.426 | 0.805 | 0.558 | 0.709 | 0.000 | 0.039 |
| rpart~4 + 31 | 0.698 | 0.000 | 0.632 | 0.703 | 0.551 | 0.769 | 0.000 | 0.005 |
| nb~4 + 28 | 0.700 | 0.000 | 0.471 | 0.822 | 0.604 | 0.729 | 0.000 | 0.000 |
| nb~4 + 9 | 0.699 | 0.000 | 0.529 | 0.839 | 0.655 | 0.756 | 0.000 | 0.002 |
| nb~35 + 20 | 0.699 | 0.000 | 0.824 | 0.449 | 0.463 | 0.815 | 0.000 | 0.001 |
| nb~4 + 33 | 0.698 | 0.000 | 0.441 | 0.898 | 0.714 | 0.736 | 0.000 | 0.005 |
| rpart~4 + 42 | 0.694 | 0.000 | 0.676 | 0.627 | 0.511 | 0.771 | 0.000 | 0.028 |
| nb~4 + 19 | 0.697 | 0.000 | 0.500 | 0.822 | 0.618 | 0.740 | 0.000 | 0.000 |
| nb~4 + 20 | 0.697 | 0.000 | 0.559 | 0.754 | 0.567 | 0.748 | 0.000 | 0.000 |
| svm~4 + 19 | 0.696 | 0.000 | 0.691 | 0.746 | 0.610 | 0.807 | 0.000 | 0.000 |
| svm~4 + 28 | 0.696 | 0.000 | 0.485 | 0.763 | 0.541 | 0.720 | 0.000 | 0.001 |
| svm~8 + 22 | 0.695 | 0.000 | 0.529 | 0.737 | 0.537 | 0.731 | 0.000 | 0.004 |
| rpart~4 + 13 | 0.692 | 0.000 | 0.544 | 0.703 | 0.514 | 0.728 | 0.000 | 0.000 |
| nb~15 + 19 | 0.695 | 0.000 | 0.441 | 0.805 | 0.566 | 0.714 | 0.000 | 0.002 |
| nb~15 + 6 | 0.695 | 0.000 | 0.397 | 0.839 | 0.587 | 0.707 | 0.000 | 0.006 |
| nb~13 + 22 | 0.695 | 0.000 | 0.603 | 0.695 | 0.532 | 0.752 | 0.000 | 0.002 |
| svm~29 + 19 | 0.695 | 0.000 | 0.603 | 0.729 | 0.562 | 0.761 | 0.000 | 0.000 |
| rpart~4 + 18 | 0.690 | 0.000 | 0.559 | 0.703 | 0.521 | 0.735 | 0.000 | 0.005 |
| svm~4 + 1 | 0.694 | 0.000 | 0.471 | 0.856 | 0.653 | 0.737 | 0.000 | 0.001 |
| nb~16 + 28 | 0.694 | 0.000 | 0.632 | 0.627 | 0.494 | 0.747 | 0.000 | 0.001 |
| svm~8 + 19 | 0.693 | 0.000 | 0.603 | 0.644 | 0.494 | 0.738 | 0.000 | 0.000 |
| nb~8 + 22 | 0.692 | 0.000 | 0.706 | 0.619 | 0.516 | 0.785 | 0.000 | 0.003 |
| nb~4 + 40 | 0.692 | 0.000 | 0.441 | 0.915 | 0.750 | 0.740 | 0.000 | 0.007 |
| svm~13 + 28 | 0.692 | 0.000 | 0.588 | 0.695 | 0.526 | 0.745 | 0.000 | 0.000 |
| rpart~15 + 13 | 0.688 | 0.000 | 0.456 | 0.780 | 0.544 | 0.713 | 0.000 | 0.151 |
| nb~16 + 17 | 0.691 | 0.000 | 0.485 | 0.780 | 0.559 | 0.724 | 0.000 | 0.001 |
| svm~19 + 38 | 0.691 | 0.000 | 0.632 | 0.678 | 0.531 | 0.762 | 0.000 | 0.003 |
| rpart~15 + 20 | 0.674 | 0.000 | 0.691 | 0.661 | 0.540 | 0.788 | 0.000 | 0.000 |
| svm~15 + 2 | 0.690 | 0.000 | 0.559 | 0.754 | 0.567 | 0.748 | 0.000 | 0.472 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~15 + 28 | 0.690 | 0.000 | 0.441 | 0.805 | 0.566 | 0.714 | 0.000 | 0.002 |
| nb~4 + 37 | 0.690 | 0.000 | 0.456 | 0.814 | 0.585 | 0.722 | 0.000 | 0.004 |
| svm~40 + 6 | 0.690 | 0.000 | 0.691 | 0.576 | 0.485 | 0.764 | 0.000 | 0.050 |
| nb~8 + 19 | 0.690 | 0.000 | 0.618 | 0.686 | 0.532 | 0.757 | 0.000 | 0.000 |
| svm~8 + 6 | 0.690 | 0.000 | 0.588 | 0.720 | 0.548 | 0.752 | 0.000 | 0.005 |
| nb~4 + 6 | 0.689 | 0.000 | 0.500 | 0.814 | 0.607 | 0.738 | 0.000 | 0.002 |
| nb~15 + 22 | 0.689 | 0.000 | 0.471 | 0.788 | 0.561 | 0.721 | 0.000 | 0.004 |
| svm~4 + 40 | 0.689 | 0.000 | 0.632 | 0.610 | 0.483 | 0.742 | 0.001 | 0.139 |
| rpart~4 + 8 | 0.685 | 0.000 | 0.647 | 0.678 | 0.537 | 0.769 | 0.000 | 0.000 |
| svm~15 + 19 | 0.689 | 0.000 | 0.412 | 0.847 | 0.609 | 0.714 | 0.000 | 0.010 |
| svm~40 + 19 | 0.689 | 0.000 | 0.618 | 0.585 | 0.462 | 0.726 | 0.005 | 0.017 |
| nb~15 + 9 | 0.688 | 0.000 | 0.574 | 0.669 | 0.500 | 0.731 | 0.001 | 0.069 |
| nb~9 + 22 | 0.688 | 0.000 | 0.529 | 0.737 | 0.537 | 0.731 | 0.000 | 0.007 |
| nb~4 + 32 | 0.688 | 0.000 | 0.500 | 0.873 | 0.694 | 0.752 | 0.000 | 0.000 |
| nb~9 + 19 | 0.688 | 0.000 | 0.691 | 0.593 | 0.495 | 0.769 | 0.000 | 0.000 |
| nb~40 + 6 | 0.687 | 0.000 | 0.515 | 0.780 | 0.574 | 0.736 | 0.000 | 0.033 |
| rf~9 + 19 | 0.687 | 0.000 | 0.721 | 0.610 | 0.516 | 0.791 | 0.000 | 0.000 |
| knn~4 + 12 | 0.684 | 0.000 | 0.382 | 0.831 | 0.565 | 0.700 | 0.000 | 0.002 |
| nb~16 + 26 | 0.687 | 0.000 | 0.500 | 0.771 | 0.557 | 0.728 | 0.000 | 0.000 |
| nb~4 + 31 | 0.687 | 0.000 | 0.485 | 0.839 | 0.635 | 0.739 | 0.000 | 0.001 |
| nb~4 + 22 | 0.687 | 0.000 | 0.515 | 0.814 | 0.614 | 0.744 | 0.000 | 0.001 |
| knn~4 + 19 | 0.683 | 0.000 | 0.647 | 0.703 | 0.557 | 0.776 | 0.000 | 0.000 |
| nb~15 + 18 | 0.687 | 0.000 | 0.515 | 0.746 | 0.538 | 0.727 | 0.000 | 0.032 |
| rpart~18 + 32 | 0.684 | 0.000 | 0.632 | 0.669 | 0.524 | 0.760 | 0.000 | 0.004 |
| nb~4 + 42 | 0.686 | 0.000 | 0.397 | 0.856 | 0.614 | 0.711 | 0.000 | 0.005 |
| nb~40 + 22 | 0.686 | 0.000 | 0.662 | 0.602 | 0.489 | 0.755 | 0.001 | 0.025 |
| knn~4 + 42 | 0.681 | 0.000 | 0.838 | 0.314 | 0.413 | 0.771 | 0.021 | 0.001 |
| nb~4 + 17 | 0.686 | 0.000 | 0.471 | 0.831 | 0.615 | 0.731 | 0.000 | 0.001 |
| nb~13 + 19 | 0.685 | 0.000 | 0.779 | 0.576 | 0.515 | 0.819 | 0.000 | 0.000 |
| nb~16 + 24 | 0.685 | 0.000 | 0.515 | 0.712 | 0.507 | 0.718 | 0.001 | 0.000 |
| svm~24 + 2 | 0.685 | 0.000 | 0.456 | 0.771 | 0.534 | 0.711 | 0.000 | 0.008 |
| rpart~16 + 20 | 0.678 | 0.000 | 0.721 | 0.568 | 0.490 | 0.779 | 0.000 | 0.001 |
| rpart~35 + 6 | 0.681 | 0.000 | 0.529 | 0.737 | 0.537 | 0.731 | 0.000 | 0.007 |
| rpart~13 + 6 | 0.680 | 0.000 | 0.647 | 0.729 | 0.579 | 0.782 | 0.000 | 0.001 |
| nb~8 + 6 | 0.685 | 0.000 | 0.515 | 0.763 | 0.556 | 0.732 | 0.000 | 0.005 |
| rf~4 + 12 | 0.684 | 0.000 | 0.647 | 0.610 | 0.489 | 0.750 | 0.000 | 0.002 |
| svm~8 + 28 | 0.684 | 0.000 | 0.588 | 0.678 | 0.513 | 0.741 | 0.000 | 0.008 |
| rpart~20 + 28 | 0.671 | 0.000 | 0.750 | 0.508 | 0.468 | 0.779 | 0.000 | 0.000 |
| svm~4 + 13 | 0.684 | 0.000 | 0.456 | 0.856 | 0.646 | 0.732 | 0.000 | 0.000 |
| svm~29 + 22 | 0.684 | 0.000 | 0.618 | 0.610 | 0.477 | 0.735 | 0.001 | 0.004 |
| svm~4 + 27 | 0.684 | 0.000 | 0.515 | 0.754 | 0.547 | 0.730 | 0.000 | 0.006 |
| nb~4 + 41 | 0.683 | 0.000 | 0.441 | 0.831 | 0.600 | 0.721 | 0.000 | 0.003 |
| rpart~13 + 22 | 0.680 | 0.000 | 0.706 | 0.559 | 0.480 | 0.767 | 0.000 | 0.009 |
| nb~28 + 6 | 0.683 | 0.000 | 0.588 | 0.720 | 0.548 | 0.752 | 0.000 | 0.002 |
| rpart~2 + 19 | 0.674 | 0.000 | 0.809 | 0.381 | 0.430 | 0.776 | 0.005 | 0.060 |
| svm~4 + 15 | 0.682 | 0.000 | 0.397 | 0.873 | 0.643 | 0.715 | 0.000 | 0.000 |
| svm~4 + 38 | 0.682 | 0.000 | 0.515 | 0.805 | 0.603 | 0.742 | 0.000 | 0.001 |
| rpart~4 + 32 | 0.679 | 0.000 | 0.500 | 0.729 | 0.515 | 0.717 | 0.001 | 0.001 |
| svm~13 + 19 | 0.681 | 0.000 | 0.735 | 0.534 | 0.476 | 0.778 | 0.000 | 0.000 |
| nb~8 + 28 | 0.681 | 0.000 | 0.647 | 0.686 | 0.543 | 0.771 | 0.000 | 0.002 |
| knn~40 + 28 | 0.677 | 0.000 | 0.485 | 0.814 | 0.600 | 0.733 | 0.000 | 0.005 |
| nb~15 + 20 | 0.680 | 0.000 | 0.662 | 0.610 | 0.495 | 0.758 | 0.000 | 0.003 |
| rpart~35 + 19 | 0.677 | 0.000 | 0.618 | 0.686 | 0.532 | 0.757 | 0.000 | 0.008 |
| nb~4 + 27 | 0.680 | 0.000 | 0.574 | 0.695 | 0.520 | 0.739 | 0.000 | 0.001 |
| nb~15 + 17 | 0.680 | 0.000 | 0.471 | 0.729 | 0.500 | 0.705 | 0.001 | 0.011 |
| nb~24 + 28 | 0.680 | 0.000 | 0.485 | 0.754 | 0.532 | 0.718 | 0.000 | 0.000 |
| nb~9 + 6 | 0.680 | 0.000 | 0.632 | 0.610 | 0.483 | 0.742 | 0.001 | 0.011 |
| svm~4 + 12 | 0.680 | 0.000 | 0.485 | 0.814 | 0.600 | 0.733 | 0.000 | 0.003 |
| nb~37 + 22 | 0.679 | 0.000 | 0.603 | 0.627 | 0.482 | 0.733 | 0.001 | 0.010 |
| svm~26 + 19 | 0.679 | 0.000 | 0.529 | 0.805 | 0.610 | 0.748 | 0.000 | 0.001 |
| svm~4 + 9 | 0.679 | 0.000 | 0.529 | 0.780 | 0.581 | 0.742 | 0.000 | 0.006 |
| nb~15 + 32 | 0.679 | 0.000 | 0.309 | 0.873 | 0.583 | 0.687 | 0.000 | 0.008 |
| rf~4 + 31 | 0.679 | 0.000 | 0.559 | 0.678 | 0.500 | 0.727 | 0.001 | 0.003 |
| svm~9 + 19 | 0.679 | 0.000 | 0.676 | 0.627 | 0.511 | 0.771 | 0.000 | 0.000 |
| svm~15 + 35 | 0.679 | 0.000 | 0.426 | 0.847 | 0.617 | 0.719 | 0.000 | 0.229 |
| nb~28 + 22 | 0.679 | 0.000 | 0.559 | 0.661 | 0.487 | 0.722 | 0.001 | 0.001 |
| nb~35 + 28 | 0.678 | 0.000 | 0.603 | 0.712 | 0.547 | 0.757 | 0.000 | 0.025 |
| svm~35 + 6 | 0.678 | 0.000 | 0.485 | 0.771 | 0.550 | 0.722 | 0.000 | 0.007 |
| knn~4 + 43 | 0.674 | 0.000 | 0.515 | 0.720 | 0.515 | 0.720 | 0.001 | 0.018 |
| nb~2 + 22 | 0.678 | 0.000 | 0.559 | 0.644 | 0.475 | 0.717 | 0.005 | 0.129 |
| rpart~15 + 2 | 0.671 | 0.000 | 0.647 | 0.627 | 0.500 | 0.755 | 0.000 | 0.587 |
| svm~9 + 22 | 0.678 | 0.000 | 0.500 | 0.763 | 0.548 | 0.726 | 0.000 | 0.014 |

TABLE 50-continued pairwise biomarkers from the 43 biomarker panel with significance for
Wilcoxon P-value (auc.pvalue <= 0.001*) and other metrics for the MET
event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~16 + 28 | 0.677 | 0.000 | 0.544 | 0.771 | 0.578 | 0.746 | 0.000 | 0.002 |
| svm~19 + 22 | 0.677 | 0.000 | 0.500 | 0.729 | 0.515 | 0.717 | 0.000 | 0.001 |
| nb~24 + 6 | 0.677 | 0.000 | 0.353 | 0.839 | 0.558 | 0.692 | 0.000 | 0.001 |
| rpart~15 + 26 | 0.670 | 0.000 | 0.338 | 0.864 | 0.590 | 0.694 | 0.000 | 0.061 |
| svm~16 + 38 | 0.677 | 0.000 | 0.471 | 0.754 | 0.525 | 0.712 | 0.001 | 0.054 |
| rpart~4 + 28 | 0.673 | 0.000 | 0.515 | 0.771 | 0.565 | 0.734 | 0.000 | 0.002 |
| svm~15 + 31 | 0.677 | 0.000 | 0.353 | 0.814 | 0.522 | 0.686 | 0.003 | 0.170 |
| nb~40 + 19 | 0.677 | 0.000 | 0.706 | 0.534 | 0.466 | 0.759 | 0.001 | 0.008 |
| nb~15 + 2 | 0.676 | 0.000 | 0.529 | 0.763 | 0.563 | 0.738 | 0.000 | 0.474 |
| nb~40 + 20 | 0.676 | 0.000 | 0.691 | 0.559 | 0.475 | 0.759 | 0.001 | 0.007 |
| svm~41 + 6 | 0.676 | 0.000 | 0.588 | 0.661 | 0.500 | 0.736 | 0.000 | 0.005 |
| nb~4 + 23 | 0.676 | 0.000 | 0.500 | 0.805 | 0.596 | 0.736 | 0.000 | 0.052 |
| svm~4 + 6 | 0.676 | 0.000 | 0.544 | 0.780 | 0.587 | 0.748 | 0.000 | 0.016 |
| nb~4 + 29 | 0.676 | 0.000 | 0.485 | 0.763 | 0.541 | 0.720 | 0.000 | 0.010 |
| knn~4 + 39 | 0.672 | 0.000 | 0.794 | 0.432 | 0.446 | 0.785 | 0.001 | 0.000 |
| rf~13 + 26 | 0.675 | 0.000 | 0.588 | 0.686 | 0.519 | 0.743 | 0.000 | 0.001 |
| rpart~9 + 19 | 0.662 | 0.000 | 0.706 | 0.568 | 0.485 | 0.770 | 0.000 | 0.001 |
| nb~4 + 38 | 0.675 | 0.000 | 0.544 | 0.780 | 0.587 | 0.748 | 0.000 | 0.013 |
| rf~4 + 19 | 0.675 | 0.000 | 0.574 | 0.661 | 0.494 | 0.729 | 0.000 | 0.000 |
| nb~4 + 34 | 0.675 | 0.000 | 0.441 | 0.839 | 0.612 | 0.723 | 0.000 | 0.002 |
| rf~4 + 1 | 0.675 | 0.000 | 0.632 | 0.644 | 0.506 | 0.752 | 0.000 | 0.023 |
| nb~13 + 28 | 0.675 | 0.000 | 0.544 | 0.720 | 0.529 | 0.733 | 0.000 | 0.001 |
| rpart~4 + 11 | 0.644 | 0.000 | 0.441 | 0.797 | 0.556 | 0.712 | 0.000 | 0.008 |
| svm~37 + 19 | 0.675 | 0.000 | 0.647 | 0.585 | 0.473 | 0.742 | 0.001 | 0.000 |
| nb~20 + 28 | 0.675 | 0.000 | 0.618 | 0.602 | 0.472 | 0.732 | 0.000 | 0.000 |
| nb~42 + 6 | 0.674 | 0.000 | 0.500 | 0.788 | 0.576 | 0.732 | 0.000 | 0.018 |
| rpart~33 + 19 | 0.647 | 0.000 | 0.574 | 0.720 | 0.542 | 0.746 | 0.000 | 0.001 |
| rf~4 + 16 | 0.674 | 0.000 | 0.691 | 0.602 | 0.500 | 0.772 | 0.000 | 0.002 |
| rpart~4 + 39 | 0.663 | 0.000 | 0.529 | 0.754 | 0.554 | 0.736 | 0.000 | 0.000 |
| nb~4 + 36 | 0.674 | 0.000 | 0.368 | 0.915 | 0.714 | 0.715 | 0.000 | 0.001 |
| nb~8 + 20 | 0.674 | 0.000 | 0.691 | 0.500 | 0.443 | 0.738 | 0.009 | 0.000 |
| nb~24 + 22 | 0.674 | 0.000 | 0.618 | 0.619 | 0.483 | 0.737 | 0.001 | 0.000 |
| svm~4 + 32 | 0.673 | 0.000 | 0.500 | 0.754 | 0.540 | 0.724 | 0.000 | 0.003 |
| svm~13 + 6 | 0.673 | 0.000 | 0.559 | 0.712 | 0.528 | 0.737 | 0.000 | 0.001 |
| rpart~4 + 29 | 0.669 | 0.000 | 0.559 | 0.678 | 0.500 | 0.727 | 0.001 | 0.000 |
| svm~39 + 19 | 0.673 | 0.000 | 0.632 | 0.602 | 0.478 | 0.740 | 0.000 | 0.000 |
| nb~15 + 40 | 0.672 | 0.000 | 0.382 | 0.856 | 0.605 | 0.706 | 0.000 | 0.258 |
| nb~15 + 26 | 0.672 | 0.000 | 0.471 | 0.771 | 0.542 | 0.717 | 0.000 | 0.012 |
| nb~17 + 28 | 0.672 | 0.000 | 0.529 | 0.686 | 0.493 | 0.717 | 0.001 | 0.001 |
| nb~9 + 20 | 0.672 | 0.000 | 0.544 | 0.610 | 0.446 | 0.699 | 0.021 | 0.001 |
| nb~13 + 20 | 0.672 | 0.000 | 0.603 | 0.593 | 0.461 | 0.722 | 0.004 | 0.000 |
| nb~2 + 6 | 0.672 | 0.000 | 0.588 | 0.712 | 0.541 | 0.750 | 0.000 | 0.175 |
| rpart~16 + 18 | 0.634 | 0.000 | 0.412 | 0.864 | 0.636 | 0.718 | 0.000 | 0.001 |
| svm~4 + 35 | 0.672 | 0.000 | 0.471 | 0.797 | 0.571 | 0.723 | 0.000 | 0.007 |
| svm~15 + 10 | 0.672 | 0.000 | 0.441 | 0.856 | 0.638 | 0.727 | 0.000 | 0.099 |
| knn~15 + 8 | 0.668 | 0.000 | 0.735 | 0.542 | 0.481 | 0.780 | 0.000 | 0.113 |
| knn~4 + 20 | 0.669 | 0.000 | 0.691 | 0.576 | 0.485 | 0.764 | 0.000 | 0.003 |
| nb~15 + 37 | 0.671 | 0.000 | 0.426 | 0.771 | 0.518 | 0.700 | 0.001 | 0.150 |
| svm~18 + 8 | 0.671 | 0.000 | 0.588 | 0.661 | 0.500 | 0.736 | 0.001 | 0.014 |
| nb~2 + 19 | 0.671 | 0.000 | 0.544 | 0.695 | 0.507 | 0.726 | 0.001 | 0.033 |
| nb~19 + 28 | 0.671 | 0.000 | 0.647 | 0.653 | 0.518 | 0.762 | 0.000 | 0.000 |
| rpart~19 + 20 | 0.666 | 0.000 | 0.735 | 0.500 | 0.459 | 0.766 | 0.001 | 0.003 |
| svm~4 + 42 | 0.671 | 0.000 | 0.588 | 0.669 | 0.506 | 0.738 | 0.000 | 0.012 |
| svm~16 + 26 | 0.670 | 0.000 | 0.412 | 0.788 | 0.528 | 0.699 | 0.001 | 0.000 |
| knn~15 + 16 | 0.666 | 0.000 | 0.750 | 0.466 | 0.447 | 0.764 | 0.003 | 0.002 |
| svm~16 + 10 | 0.670 | 0.000 | 0.676 | 0.627 | 0.511 | 0.771 | 0.000 | 0.033 |
| svm~17 + 19 | 0.670 | 0.000 | 0.485 | 0.754 | 0.532 | 0.718 | 0.000 | 0.001 |
| nb~41 + 6 | 0.670 | 0.000 | 0.441 | 0.814 | 0.577 | 0.716 | 0.000 | 0.016 |
| nb~40 + 28 | 0.670 | 0.000 | 0.662 | 0.661 | 0.529 | 0.772 | 0.000 | 0.028 |
| svm~15 + 40 | 0.670 | 0.000 | 0.485 | 0.661 | 0.452 | 0.690 | 0.040 | 0.565 |
| rf~4 + 8 | 0.670 | 0.000 | 0.721 | 0.492 | 0.450 | 0.753 | 0.003 | 0.001 |
| knn~10 + 19 | 0.665 | 0.000 | 0.382 | 0.881 | 0.650 | 0.712 | 0.000 | 0.000 |
| nb~37 + 19 | 0.669 | 0.000 | 0.544 | 0.678 | 0.493 | 0.721 | 0.000 | 0.000 |
| knn~4 + 31 | 0.665 | 0.000 | 0.544 | 0.712 | 0.521 | 0.730 | 0.000 | 0.002 |
| nb~33 + 6 | 0.669 | 0.000 | 0.544 | 0.763 | 0.569 | 0.744 | 0.000 | 0.029 |
| nb~20 + 22 | 0.669 | 0.000 | 0.603 | 0.619 | 0.477 | 0.730 | 0.001 | 0.001 |
| rf~8 + 26 | 0.669 | 0.000 | 0.574 | 0.695 | 0.520 | 0.739 | 0.000 | 0.002 |
| svm~33 + 19 | 0.669 | 0.000 | 0.574 | 0.627 | 0.470 | 0.718 | 0.003 | 0.000 |
| nb~19 + 6 | 0.669 | 0.000 | 0.515 | 0.780 | 0.574 | 0.736 | 0.000 | 0.001 |
| nb~4 + 18 | 0.669 | 0.000 | 0.485 | 0.771 | 0.550 | 0.722 | 0.000 | 0.004 |
| svm~4 + 18 | 0.668 | 0.000 | 0.441 | 0.797 | 0.556 | 0.712 | 0.000 | 0.016 |
| knn~15 + 13 | 0.665 | 0.000 | 0.735 | 0.517 | 0.467 | 0.772 | 0.001 | 0.235 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~4 + 39 | 0.668 | 0.000 | 0.544 | 0.729 | 0.536 | 0.735 | 0.000 | 0.000 |
| svm~42 + 15 | 0.668 | 0.000 | 0.471 | 0.720 | 0.492 | 0.702 | 0.006 | 0.638 |
| svm~10 + 6 | 0.668 | 0.000 | 0.485 | 0.797 | 0.579 | 0.729 | 0.000 | 0.004 |
| rf~4 + 24 | 0.668 | 0.000 | 0.574 | 0.678 | 0.506 | 0.734 | 0.000 | 0.000 |
| svm~19 + 6 | 0.668 | 0.000 | 0.559 | 0.720 | 0.535 | 0.739 | 0.000 | 0.001 |
| nb~1 + 6 | 0.667 | 0.000 | 0.485 | 0.771 | 0.550 | 0.722 | 0.000 | 0.007 |
| nb~15 + 33 | 0.667 | 0.000 | 0.471 | 0.737 | 0.508 | 0.707 | 0.003 | 0.452 |
| svm~12 + 6 | 0.667 | 0.000 | 0.544 | 0.703 | 0.514 | 0.728 | 0.000 | 0.002 |
| nb~15 + 31 | 0.667 | 0.000 | 0.412 | 0.788 | 0.528 | 0.699 | 0.002 | 0.155 |
| rpart~15 + 31 | 0.662 | 0.000 | 0.324 | 0.890 | 0.629 | 0.695 | 0.000 | 0.155 |
| knn~4 + 22 | 0.664 | 0.000 | 0.735 | 0.475 | 0.446 | 0.757 | 0.002 | 0.005 |
| svm~40 + 24 | 0.667 | 0.000 | 0.632 | 0.653 | 0.512 | 0.755 | 0.000 | 0.006 |
| nb~12 + 6 | 0.667 | 0.000 | 0.618 | 0.644 | 0.500 | 0.745 | 0.000 | 0.002 |
| nb~18 + 28 | 0.667 | 0.000 | 0.515 | 0.661 | 0.467 | 0.703 | 0.012 | 0.005 |
| knn~15 + 31 | 0.663 | 0.000 | 0.706 | 0.585 | 0.495 | 0.775 | 0.000 | 0.060 |
| svm~4 + 24 | 0.667 | 0.000 | 0.426 | 0.864 | 0.644 | 0.723 | 0.000 | 0.000 |
| nb~42 + 22 | 0.667 | 0.000 | 0.647 | 0.525 | 0.440 | 0.721 | 0.021 | 0.032 |
| rpart~4 + 34 | 0.666 | 0.000 | 0.618 | 0.602 | 0.472 | 0.732 | 0.002 | 0.063 |
| svm~4 + 37 | 0.667 | 0.000 | 0.574 | 0.686 | 0.513 | 0.736 | 0.000 | 0.003 |
| svm~4 + 2 | 0.667 | 0.000 | 0.662 | 0.678 | 0.542 | 0.777 | 0.000 | 0.077 |
| nb~22 + 6 | 0.667 | 0.000 | 0.559 | 0.695 | 0.514 | 0.732 | 0.000 | 0.004 |
| nb~42 + 15 | 0.666 | 0.000 | 0.485 | 0.712 | 0.493 | 0.706 | 0.005 | 0.521 |
| svm~40 + 22 | 0.666 | 0.000 | 0.721 | 0.475 | 0.441 | 0.747 | 0.013 | 0.086 |
| knn~29 + 18 | 0.662 | 0.000 | 0.529 | 0.695 | 0.500 | 0.719 | 0.002 | 0.029 |
| nb~12 + 22 | 0.666 | 0.000 | 0.559 | 0.669 | 0.494 | 0.725 | 0.002 | 0.001 |
| svm~10 + 22 | 0.666 | 0.000 | 0.544 | 0.678 | 0.493 | 0.721 | 0.002 | 0.015 |
| svm~35 + 22 | 0.666 | 0.000 | 0.456 | 0.771 | 0.534 | 0.711 | 0.000 | 0.024 |
| svm~8 + 26 | 0.666 | 0.000 | 0.441 | 0.780 | 0.536 | 0.708 | 0.001 | 0.006 |
| nb~4 + 25 | 0.666 | 0.000 | 0.515 | 0.805 | 0.603 | 0.742 | 0.000 | 0.002 |
| nb~17 + 6 | 0.666 | 0.000 | 0.588 | 0.661 | 0.500 | 0.736 | 0.000 | 0.002 |
| svm~26 + 22 | 0.666 | 0.000 | 0.500 | 0.720 | 0.507 | 0.714 | 0.001 | 0.005 |
| nb~38 + 28 | 0.666 | 0.000 | 0.559 | 0.703 | 0.521 | 0.735 | 0.000 | 0.023 |
| nb~18 + 13 | 0.666 | 0.000 | 0.618 | 0.559 | 0.447 | 0.717 | 0.024 | 0.011 |
| nb~37 + 6 | 0.666 | 0.000 | 0.588 | 0.678 | 0.513 | 0.741 | 0.000 | 0.016 |
| rf~4 + 13 | 0.666 | 0.000 | 0.471 | 0.771 | 0.542 | 0.717 | 0.000 | 0.002 |
| nb~4 + 7 | 0.666 | 0.000 | 0.456 | 0.771 | 0.534 | 0.711 | 0.001 | 0.028 |
| nb~4 + 10 | 0.666 | 0.000 | 0.353 | 0.924 | 0.727 | 0.712 | 0.000 | 0.003 |
| svm~24 + 6 | 0.666 | 0.000 | 0.426 | 0.788 | 0.537 | 0.705 | 0.000 | 0.018 |
| rf~4 + 39 | 0.665 | 0.000 | 0.662 | 0.602 | 0.489 | 0.755 | 0.000 | 0.002 |
| nb~19 + 22 | 0.665 | 0.000 | 0.706 | 0.568 | 0.485 | 0.770 | 0.000 | 0.000 |
| svm~26 + 28 | 0.665 | 0.000 | 0.426 | 0.797 | 0.547 | 0.707 | 0.000 | 0.004 |
| nb~33 + 19 | 0.665 | 0.000 | 0.721 | 0.568 | 0.490 | 0.779 | 0.000 | 0.016 |
| rf~4 + 42 | 0.665 | 0.000 | 0.588 | 0.644 | 0.488 | 0.731 | 0.002 | 0.015 |
| svm~24 + 19 | 0.665 | 0.000 | 0.456 | 0.814 | 0.585 | 0.722 | 0.000 | 0.002 |
| nb~4 + 26 | 0.665 | 0.000 | 0.426 | 0.856 | 0.630 | 0.721 | 0.000 | 0.001 |
| nb~15 + 10 | 0.665 | 0.000 | 0.706 | 0.483 | 0.440 | 0.740 | 0.018 | 0.404 |
| knn~15 + 19 | 0.661 | 0.000 | 0.794 | 0.398 | 0.432 | 0.770 | 0.006 | 0.003 |
| nb~19 + 20 | 0.665 | 0.000 | 0.706 | 0.517 | 0.457 | 0.753 | 0.001 | 0.000 |
| rf~15 + 2 | 0.665 | 0.000 | 0.647 | 0.619 | 0.494 | 0.753 | 0.000 | 0.846 |
| svm~40 + 28 | 0.665 | 0.000 | 0.676 | 0.602 | 0.495 | 0.763 | 0.000 | 0.039 |
| nb~1 + 22 | 0.664 | 0.000 | 0.603 | 0.610 | 0.471 | 0.727 | 0.003 | 0.008 |
| svm~15 + 24 | 0.664 | 0.000 | 0.338 | 0.890 | 0.639 | 0.700 | 0.000 | 0.135 |
| rpart~4 + 20 | 0.640 | 0.000 | 0.765 | 0.508 | 0.473 | 0.789 | 0.000 | 0.001 |
| svm~18 + 2 | 0.664 | 0.000 | 0.632 | 0.610 | 0.483 | 0.742 | 0.002 | 0.252 |
| svm~37 + 22 | 0.664 | 0.000 | 0.632 | 0.636 | 0.500 | 0.750 | 0.000 | 0.042 |
| nb~34 + 6 | 0.664 | 0.000 | 0.500 | 0.703 | 0.493 | 0.709 | 0.002 | 0.012 |
| rpart~1 + 20 | 0.659 | 0.000 | 0.779 | 0.483 | 0.465 | 0.792 | 0.000 | 0.000 |
| nb~4 + 39 | 0.664 | 0.000 | 0.515 | 0.814 | 0.614 | 0.744 | 0.000 | 0.004 |
| nb~31 + 6 | 0.664 | 0.000 | 0.515 | 0.729 | 0.522 | 0.723 | 0.000 | 0.007 |
| svm~2 + 28 | 0.664 | 0.000 | 0.647 | 0.602 | 0.484 | 0.747 | 0.001 | 0.039 |
| knn~24 + 22 | 0.659 | 0.000 | 0.485 | 0.771 | 0.550 | 0.722 | 0.000 | 0.014 |
| nb~18 + 6 | 0.664 | 0.000 | 0.544 | 0.712 | 0.521 | 0.730 | 0.000 | 0.009 |
| rf~26 + 22 | 0.663 | 0.000 | 0.618 | 0.669 | 0.519 | 0.752 | 0.000 | 0.015 |
| svm~31 + 6 | 0.663 | 0.000 | 0.544 | 0.661 | 0.481 | 0.716 | 0.004 | 0.044 |
| nb~20 + 6 | 0.663 | 0.000 | 0.544 | 0.678 | 0.493 | 0.721 | 0.001 | 0.001 |
| nb~4 + 43 | 0.663 | 0.000 | 0.397 | 0.873 | 0.643 | 0.715 | 0.000 | 0.006 |
| svm~1 + 22 | 0.663 | 0.000 | 0.500 | 0.771 | 0.557 | 0.728 | 0.000 | 0.006 |
| nb~40 + 17 | 0.663 | 0.000 | 0.632 | 0.610 | 0.483 | 0.742 | 0.001 | 0.140 |
| nb~37 + 28 | 0.663 | 0.000 | 0.603 | 0.653 | 0.500 | 0.740 | 0.000 | 0.019 |
| nb~17 + 8 | 0.663 | 0.000 | 0.559 | 0.686 | 0.507 | 0.730 | 0.001 | 0.017 |
| svm~12 + 19 | 0.663 | 0.000 | 0.588 | 0.678 | 0.513 | 0.741 | 0.000 | 0.004 |
| nb~27 + 6 | 0.663 | 0.000 | 0.588 | 0.636 | 0.482 | 0.728 | 0.001 | 0.012 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~32 + 22 | 0.663 | 0.000 | 0.559 | 0.627 | 0.463 | 0.712 | 0.006 | 0.002 |
| rf~42 + 19 | 0.663 | 0.000 | 0.662 | 0.593 | 0.484 | 0.753 | 0.000 | 0.000 |
| nb~2 + 28 | 0.663 | 0.000 | 0.529 | 0.669 | 0.480 | 0.712 | 0.005 | 0.101 |
| rpart~4 + 24 | 0.655 | 0.000 | 0.412 | 0.805 | 0.549 | 0.704 | 0.000 | 0.001 |
| svm~18 + 19 | 0.663 | 0.000 | 0.603 | 0.669 | 0.513 | 0.745 | 0.000 | 0.002 |
| knn~9 + 19 | 0.659 | 0.000 | 0.691 | 0.576 | 0.485 | 0.764 | 0.000 | 0.005 |
| svm~38 + 22 | 0.663 | 0.000 | 0.632 | 0.712 | 0.558 | 0.771 | 0.000 | 0.035 |
| rf~4 + 38 | 0.662 | 0.000 | 0.515 | 0.703 | 0.500 | 0.716 | 0.001 | 0.024 |
| nb~17 + 22 | 0.662 | 0.000 | 0.662 | 0.568 | 0.469 | 0.744 | 0.001 | 0.002 |
| nb~10 + 6 | 0.662 | 0.000 | 0.412 | 0.847 | 0.609 | 0.714 | 0.000 | 0.012 |
| rpart~4 + 6 | 0.658 | 0.000 | 0.574 | 0.703 | 0.527 | 0.741 | 0.000 | 0.012 |
| knn~35 + 19 | 0.658 | 0.000 | 0.824 | 0.424 | 0.452 | 0.806 | 0.001 | 0.011 |
| rpart~20 + 6 | 0.660 | 0.000 | 0.574 | 0.627 | 0.470 | 0.718 | 0.003 | 0.000 |
| nb~2 + 20 | 0.662 | 0.000 | 0.603 | 0.678 | 0.519 | 0.748 | 0.000 | 0.078 |
| knn~16 + 10 | 0.655 | 0.000 | 0.824 | 0.432 | 0.455 | 0.810 | 0.001 | 0.031 |
| svm~10 + 28 | 0.662 | 0.000 | 0.559 | 0.686 | 0.507 | 0.730 | 0.000 | 0.022 |
| svm~2 + 22 | 0.662 | 0.000 | 0.691 | 0.542 | 0.465 | 0.753 | 0.001 | 0.179 |
| svm~10 + 19 | 0.662 | 0.000 | 0.559 | 0.712 | 0.528 | 0.737 | 0.000 | 0.001 |
| knn~4 + 38 | 0.658 | 0.000 | 0.750 | 0.475 | 0.451 | 0.767 | 0.002 | 0.002 |
| svm~19 + 32 | 0.661 | 0.000 | 0.485 | 0.771 | 0.550 | 0.722 | 0.000 | 0.001 |
| nb~15 + 12 | 0.661 | 0.000 | 0.485 | 0.720 | 0.500 | 0.708 | 0.002 | 0.013 |
| nb~17 + 13 | 0.661 | 0.000 | 0.618 | 0.619 | 0.483 | 0.737 | 0.001 | 0.014 |
| nb~18 + 22 | 0.661 | 0.000 | 0.662 | 0.610 | 0.495 | 0.758 | 0.000 | 0.005 |
| rf~4 + 41 | 0.660 | 0.000 | 0.588 | 0.636 | 0.482 | 0.728 | 0.002 | 0.007 |
| rpart~4 + 35 | 0.652 | 0.000 | 0.544 | 0.737 | 0.544 | 0.737 | 0.000 | 0.016 |
| rpart~24 + 19 | 0.654 | 0.000 | 0.603 | 0.593 | 0.461 | 0.722 | 0.003 | 0.002 |
| knn~16 + 19 | 0.658 | 0.000 | 0.647 | 0.610 | 0.489 | 0.750 | 0.000 | 0.000 |
| nb~33 + 22 | 0.660 | 0.000 | 0.706 | 0.492 | 0.444 | 0.744 | 0.007 | 0.031 |
| svm~24 + 28 | 0.659 | 0.000 | 0.250 | 0.890 | 0.567 | 0.673 | 0.001 | 0.012 |
| nb~19 + 32 | 0.659 | 0.000 | 0.515 | 0.720 | 0.515 | 0.720 | 0.000 | 0.000 |
| rf~39 + 32 | 0.659 | 0.000 | 0.676 | 0.559 | 0.469 | 0.750 | 0.001 | 0.000 |
| svm~42 + 6 | 0.659 | 0.000 | 0.574 | 0.661 | 0.494 | 0.729 | 0.001 | 0.012 |
| nb~24 + 19 | 0.659 | 0.000 | 0.574 | 0.712 | 0.534 | 0.743 | 0.000 | 0.000 |
| rf~15 + 28 | 0.659 | 0.000 | 0.618 | 0.585 | 0.462 | 0.726 | 0.004 | 0.204 |
| rpart~4 + 38 | 0.658 | 0.000 | 0.603 | 0.661 | 0.506 | 0.743 | 0.000 | 0.045 |
| knn~4 + 34 | 0.655 | 0.000 | 0.765 | 0.415 | 0.430 | 0.754 | 0.008 | 0.009 |
| nb~41 + 22 | 0.659 | 0.000 | 0.603 | 0.636 | 0.488 | 0.735 | 0.001 | 0.027 |
| rpart~35 + 20 | 0.657 | 0.000 | 0.603 | 0.644 | 0.494 | 0.738 | 0.001 | 0.050 |
| rf~31 + 19 | 0.659 | 0.000 | 0.676 | 0.542 | 0.460 | 0.744 | 0.002 | 0.000 |
| rpart~5 + 28 | 0.651 | 0.000 | 0.706 | 0.602 | 0.505 | 0.780 | 0.000 | 0.029 |
| rf~35 + 6 | 0.658 | 0.000 | 0.618 | 0.585 | 0.462 | 0.726 | 0.009 | 0.007 |
| nb~24 + 20 | 0.658 | 0.000 | 0.662 | 0.517 | 0.441 | 0.726 | 0.007 | 0.000 |
| rpart~24 + 10 | 0.638 | 0.000 | 0.382 | 0.839 | 0.578 | 0.702 | 0.000 | 0.005 |
| nb~12 + 28 | 0.658 | 0.000 | 0.632 | 0.669 | 0.524 | 0.760 | 0.000 | 0.001 |
| svm~4 + 22 | 0.658 | 0.000 | 0.544 | 0.771 | 0.578 | 0.746 | 0.000 | 0.002 |
| nb~36 + 6 | 0.658 | 0.000 | 0.485 | 0.754 | 0.532 | 0.718 | 0.000 | 0.010 |
| nb~34 + 22 | 0.658 | 0.000 | 0.618 | 0.576 | 0.457 | 0.723 | 0.009 | 0.012 |
| knn~16 + 38 | 0.653 | 0.000 | 0.824 | 0.373 | 0.431 | 0.786 | 0.007 | 0.206 |
| svm~29 + 6 | 0.658 | 0.000 | 0.529 | 0.746 | 0.545 | 0.733 | 0.000 | 0.009 |
| nb~38 + 6 | 0.658 | 0.000 | 0.500 | 0.746 | 0.531 | 0.721 | 0.000 | 0.061 |
| svm~1 + 19 | 0.658 | 0.000 | 0.603 | 0.636 | 0.488 | 0.735 | 0.000 | 0.003 |
| nb~16 + 32 | 0.658 | 0.000 | 0.515 | 0.729 | 0.522 | 0.723 | 0.000 | 0.005 |
| svm~38 + 28 | 0.658 | 0.000 | 0.632 | 0.695 | 0.544 | 0.766 | 0.000 | 0.008 |
| rpart~20 + 22 | 0.654 | 0.000 | 0.515 | 0.703 | 0.500 | 0.716 | 0.001 | 0.005 |
| svm~15 + 39 | 0.658 | 0.000 | 0.500 | 0.780 | 0.567 | 0.730 | 0.000 | 0.153 |
| nb~41 + 28 | 0.658 | 0.000 | 0.559 | 0.602 | 0.447 | 0.703 | 0.024 | 0.008 |
| rpart~8 + 19 | 0.655 | 0.000 | 0.618 | 0.644 | 0.500 | 0.745 | 0.000 | 0.001 |
| nb~31 + 19 | 0.657 | 0.000 | 0.603 | 0.695 | 0.532 | 0.752 | 0.000 | 0.002 |
| rpart~15 + 8 | 0.656 | 0.000 | 0.426 | 0.763 | 0.509 | 0.698 | 0.003 | 0.243 |
| rf~15 + 8 | 0.657 | 0.000 | 0.529 | 0.686 | 0.493 | 0.717 | 0.002 | 0.788 |
| rf~7 + 19 | 0.657 | 0.000 | 0.735 | 0.551 | 0.485 | 0.783 | 0.000 | 0.016 |
| rf~29 + 19 | 0.657 | 0.000 | 0.676 | 0.602 | 0.495 | 0.763 | 0.000 | 0.000 |
| nb~35 + 17 | 0.657 | 0.000 | 0.618 | 0.610 | 0.477 | 0.735 | 0.000 | 0.135 |
| svm~16 + 17 | 0.657 | 0.000 | 0.515 | 0.737 | 0.530 | 0.725 | 0.000 | 0.004 |
| knn~18 + 28 | 0.653 | 0.000 | 0.735 | 0.441 | 0.431 | 0.743 | 0.010 | 0.002 |
| nb~16 + 2 | 0.657 | 0.000 | 0.632 | 0.678 | 0.531 | 0.762 | 0.000 | 0.422 |
| nb~26 + 28 | 0.656 | 0.000 | 0.544 | 0.678 | 0.493 | 0.721 | 0.001 | 0.002 |
| rf~16 + 18 | 0.656 | 0.000 | 0.632 | 0.678 | 0.531 | 0.762 | 0.000 | 0.008 |
| svm~4 + 25 | 0.656 | 0.000 | 0.588 | 0.653 | 0.494 | 0.733 | 0.000 | 0.031 |
| nb~15 + 41 | 0.656 | 0.000 | 0.574 | 0.602 | 0.453 | 0.710 | 0.019 | 0.212 |
| rpart~40 + 24 | 0.650 | 0.000 | 0.471 | 0.771 | 0.542 | 0.717 | 0.000 | 0.005 |
| nb~17 + 19 | 0.656 | 0.000 | 0.706 | 0.610 | 0.511 | 0.783 | 0.000 | 0.000 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~27 + 6 | 0.656 | 0.000 | 0.588 | 0.619 | 0.471 | 0.723 | 0.002 | 0.034 |
| svm~19 + 34 | 0.656 | 0.000 | 0.588 | 0.610 | 0.465 | 0.720 | 0.002 | 0.001 |
| rpart~16 + 28 | 0.655 | 0.000 | 0.515 | 0.669 | 0.473 | 0.705 | 0.011 | 0.009 |
| rf~7 + 6 | 0.656 | 0.000 | 0.691 | 0.585 | 0.490 | 0.767 | 0.000 | 0.022 |
| knn~29 + 6 | 0.652 | 0.000 | 0.529 | 0.695 | 0.500 | 0.719 | 0.001 | 0.022 |
| knn~4 + 1 | 0.652 | 0.000 | 0.750 | 0.381 | 0.411 | 0.726 | 0.072 | 0.004 |
| rpart~24 + 5 | 0.654 | 0.000 | 0.485 | 0.746 | 0.524 | 0.715 | 0.001 | 0.007 |
| nb~32 + 6 | 0.656 | 0.000 | 0.412 | 0.847 | 0.609 | 0.714 | 0.000 | 0.004 |
| nb~10 + 22 | 0.656 | 0.000 | 0.632 | 0.534 | 0.439 | 0.716 | 0.030 | 0.024 |
| rpart~23 + 19 | 0.648 | 0.000 | 0.721 | 0.466 | 0.438 | 0.743 | 0.008 | 0.021 |
| rpart~4 + 12 | 0.652 | 0.000 | 0.603 | 0.653 | 0.500 | 0.740 | 0.000 | 0.004 |
| rf~4 + 14 | 0.656 | 0.000 | 0.544 | 0.678 | 0.493 | 0.721 | 0.001 | 0.007 |
| nb~33 + 20 | 0.656 | 0.000 | 0.824 | 0.398 | 0.441 | 0.797 | 0.003 | 0.013 |
| knn~4 + 35 | 0.652 | 0.000 | 0.471 | 0.746 | 0.516 | 0.710 | 0.001 | 0.050 |
| rf~4 + 20 | 0.655 | 0.000 | 0.618 | 0.551 | 0.442 | 0.714 | 0.018 | 0.005 |
| nb~18 + 8 | 0.655 | 0.000 | 0.485 | 0.695 | 0.478 | 0.701 | 0.018 | 0.023 |
| svm~5 + 28 | 0.655 | 0.000 | 0.603 | 0.678 | 0.519 | 0.748 | 0.000 | 0.024 |
| rf~10 + 19 | 0.655 | 0.000 | 0.574 | 0.686 | 0.513 | 0.736 | 0.000 | 0.000 |
| svm~28 + 22 | 0.655 | 0.000 | 0.515 | 0.763 | 0.556 | 0.732 | 0.000 | 0.001 |
| rpart~10 + 22 | 0.652 | 0.000 | 0.500 | 0.678 | 0.472 | 0.702 | 0.020 | 0.048 |
| rf~4 + 18 | 0.655 | 0.000 | 0.603 | 0.661 | 0.506 | 0.743 | 0.000 | 0.006 |
| nb~16 + 37 | 0.655 | 0.000 | 0.647 | 0.593 | 0.478 | 0.745 | 0.001 | 0.085 |
| nb~19 + 34 | 0.655 | 0.000 | 0.574 | 0.686 | 0.513 | 0.736 | 0.000 | 0.001 |
| rpart~4 + 25 | 0.652 | 0.000 | 0.706 | 0.534 | 0.466 | 0.759 | 0.001 | 0.024 |
| knn~26 + 22 | 0.650 | 0.000 | 0.735 | 0.492 | 0.455 | 0.763 | 0.000 | 0.002 |
| rf~35 + 19 | 0.654 | 0.000 | 0.618 | 0.636 | 0.494 | 0.743 | 0.000 | 0.010 |
| rpart~15 + 3 | 0.647 | 0.000 | 0.279 | 0.890 | 0.594 | 0.682 | 0.000 | 0.294 |
| svm~15 + 22 | 0.654 | 0.000 | 0.426 | 0.805 | 0.558 | 0.709 | 0.000 | 0.004 |
| nb~28 + 32 | 0.654 | 0.000 | 0.544 | 0.644 | 0.468 | 0.710 | 0.003 | 0.004 |
| svm~22 + 6 | 0.654 | 0.000 | 0.426 | 0.746 | 0.492 | 0.693 | 0.008 | 0.006 |
| knn~42 + 19 | 0.649 | 0.000 | 0.721 | 0.551 | 0.480 | 0.774 | 0.000 | 0.005 |
| nb~24 + 32 | 0.654 | 0.000 | 0.235 | 0.873 | 0.516 | 0.665 | 0.009 | 0.000 |
| nb~16 + 35 | 0.654 | 0.000 | 0.515 | 0.737 | 0.530 | 0.725 | 0.001 | 0.205 |
| nb~37 + 20 | 0.654 | 0.000 | 0.559 | 0.602 | 0.447 | 0.703 | 0.013 | 0.002 |
| rpart~40 + 19 | 0.648 | 0.000 | 0.853 | 0.364 | 0.436 | 0.811 | 0.002 | 0.056 |
| rpart~4 + 9 | 0.651 | 0.001 | 0.588 | 0.720 | 0.548 | 0.752 | 0.000 | 0.006 |
| rf~15 + 39 | 0.653 | 0.001 | 0.544 | 0.720 | 0.529 | 0.733 | 0.000 | 0.221 |
| svm~4 + 33 | 0.653 | 0.001 | 0.544 | 0.729 | 0.536 | 0.735 | 0.000 | 0.016 |
| nb~13 + 26 | 0.653 | 0.001 | 0.662 | 0.483 | 0.425 | 0.713 | 0.051 | 0.002 |
| svm~27 + 19 | 0.653 | 0.001 | 0.588 | 0.610 | 0.465 | 0.720 | 0.004 | 0.005 |
| svm~15 + 37 | 0.653 | 0.001 | 0.412 | 0.805 | 0.549 | 0.704 | 0.000 | 0.070 |
| nb~16 + 38 | 0.653 | 0.001 | 0.471 | 0.729 | 0.500 | 0.705 | 0.005 | 0.079 |
| rpart~16 + 6 | 0.645 | 0.001 | 0.471 | 0.695 | 0.471 | 0.695 | 0.009 | 0.098 |
| rpart~4 + 5 | 0.647 | 0.001 | 0.603 | 0.653 | 0.500 | 0.740 | 0.001 | 0.023 |
| svm~2 + 19 | 0.653 | 0.001 | 0.676 | 0.500 | 0.438 | 0.728 | 0.011 | 0.019 |
| rpart~24 + 20 | 0.644 | 0.001 | 0.529 | 0.712 | 0.514 | 0.724 | 0.000 | 0.001 |
| svm~14 + 22 | 0.653 | 0.001 | 0.515 | 0.729 | 0.522 | 0.723 | 0.000 | 0.009 |
| nb~36 + 22 | 0.653 | 0.001 | 0.632 | 0.576 | 0.462 | 0.731 | 0.003 | 0.013 |
| rpart~26 + 28 | 0.649 | 0.001 | 0.456 | 0.746 | 0.508 | 0.704 | 0.001 | 0.001 |
| rf~15 + 9 | 0.652 | 0.001 | 0.544 | 0.695 | 0.507 | 0.726 | 0.000 | 0.451 |
| knn~24 + 19 | 0.648 | 0.001 | 0.824 | 0.373 | 0.431 | 0.786 | 0.004 | 0.002 |
| nb~23 + 6 | 0.652 | 0.001 | 0.500 | 0.754 | 0.540 | 0.724 | 0.000 | 0.158 |
| svm~34 + 22 | 0.652 | 0.001 | 0.632 | 0.576 | 0.462 | 0.731 | 0.003 | 0.007 |
| nb~18 + 37 | 0.652 | 0.001 | 0.500 | 0.695 | 0.486 | 0.707 | 0.006 | 0.144 |
| svm~31 + 22 | 0.652 | 0.001 | 0.574 | 0.619 | 0.464 | 0.716 | 0.009 | 0.011 |
| rpart~18 + 13 | 0.651 | 0.001 | 0.559 | 0.602 | 0.447 | 0.703 | 0.037 | 0.050 |
| knn~16 + 20 | 0.649 | 0.001 | 0.779 | 0.483 | 0.465 | 0.792 | 0.000 | 0.032 |
| nb~40 + 24 | 0.652 | 0.001 | 0.529 | 0.636 | 0.456 | 0.701 | 0.023 | 0.005 |
| nb~15 + 34 | 0.652 | 0.001 | 0.397 | 0.797 | 0.529 | 0.696 | 0.001 | 0.129 |
| svm~16 + 24 | 0.652 | 0.001 | 0.265 | 0.890 | 0.581 | 0.677 | 0.000 | 0.005 |
| svm~35 + 28 | 0.652 | 0.001 | 0.412 | 0.814 | 0.560 | 0.706 | 0.000 | 0.271 |
| nb~26 + 6 | 0.652 | 0.001 | 0.559 | 0.703 | 0.521 | 0.735 | 0.000 | 0.003 |
| nb~20 + 32 | 0.652 | 0.001 | 0.618 | 0.525 | 0.429 | 0.705 | 0.029 | 0.001 |
| rpart~4 + 27 | 0.641 | 0.001 | 0.559 | 0.712 | 0.528 | 0.737 | 0.000 | 0.001 |
| nb~26 + 22 | 0.652 | 0.001 | 0.676 | 0.602 | 0.495 | 0.763 | 0.000 | 0.002 |
| rpart~13 + 26 | 0.647 | 0.001 | 0.500 | 0.788 | 0.576 | 0.732 | 0.000 | 0.000 |
| rpart~7 + 20 | 0.644 | 0.001 | 0.735 | 0.475 | 0.446 | 0.757 | 0.005 | 0.052 |
| svm~15 + 17 | 0.652 | 0.001 | 0.397 | 0.754 | 0.482 | 0.685 | 0.005 | 0.033 |
| nb~16 + 9 | 0.652 | 0.001 | 0.471 | 0.703 | 0.478 | 0.697 | 0.022 | 0.058 |
| rpart~39 + 19 | 0.644 | 0.001 | 0.735 | 0.458 | 0.439 | 0.750 | 0.004 | 0.010 |
| svm~18 + 28 | 0.652 | 0.001 | 0.485 | 0.686 | 0.471 | 0.698 | 0.009 | 0.010 |
| nb~26 + 19 | 0.652 | 0.001 | 0.691 | 0.542 | 0.465 | 0.753 | 0.001 | 0.001 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| knn~16 + 18 | 0.648 | 0.001 | 0.779 | 0.373 | 0.417 | 0.746 | 0.038 | 0.004 |
| nb~17 + 32 | 0.651 | 0.001 | 0.515 | 0.678 | 0.479 | 0.708 | 0.002 | 0.002 |
| svm~28 + 6 | 0.651 | 0.001 | 0.500 | 0.720 | 0.507 | 0.714 | 0.001 | 0.002 |
| rf~16 + 19 | 0.651 | 0.001 | 0.603 | 0.585 | 0.456 | 0.719 | 0.007 | 0.001 |
| nb~4 + 5 | 0.651 | 0.001 | 0.456 | 0.797 | 0.564 | 0.718 | 0.000 | 0.006 |
| svm~42 + 19 | 0.651 | 0.001 | 0.500 | 0.712 | 0.500 | 0.712 | 0.001 | 0.002 |
| svm~35 + 17 | 0.651 | 0.001 | 0.515 | 0.712 | 0.507 | 0.718 | 0.001 | 0.217 |
| nb~1 + 28 | 0.651 | 0.001 | 0.529 | 0.729 | 0.529 | 0.729 | 0.000 | 0.007 |
| nb~12 + 18 | 0.651 | 0.001 | 0.500 | 0.686 | 0.479 | 0.704 | 0.005 | 0.004 |
| nb~9 + 28 | 0.651 | 0.001 | 0.500 | 0.720 | 0.507 | 0.714 | 0.001 | 0.021 |
| nb~18 + 19 | 0.651 | 0.001 | 0.647 | 0.602 | 0.484 | 0.747 | 0.000 | 0.002 |
| knn~16 + 28 | 0.648 | 0.001 | 0.838 | 0.364 | 0.432 | 0.796 | 0.003 | 0.001 |
| knn~16 + 6 | 0.648 | 0.001 | 0.515 | 0.661 | 0.467 | 0.703 | 0.016 | 0.038 |
| nb~33 + 28 | 0.651 | 0.001 | 0.603 | 0.585 | 0.456 | 0.719 | 0.014 | 0.036 |
| svm~35 + 20 | 0.651 | 0.001 | 0.618 | 0.585 | 0.462 | 0.726 | 0.005 | 0.030 |
| svm~24 + 8 | 0.651 | 0.001 | 0.338 | 0.831 | 0.535 | 0.685 | 0.003 | 0.002 |
| knn~4 + 8 | 0.647 | 0.001 | 0.794 | 0.381 | 0.425 | 0.763 | 0.010 | 0.004 |
| rpart~4 + 21 | 0.648 | 0.001 | 0.426 | 0.771 | 0.518 | 0.700 | 0.003 | 0.044 |
| rf~16 + 38 | 0.651 | 0.001 | 0.632 | 0.627 | 0.494 | 0.747 | 0.000 | 0.244 |
| knn~2 + 20 | 0.648 | 0.001 | 0.779 | 0.432 | 0.442 | 0.773 | 0.003 | 0.013 |
| svm~24 + 13 | 0.650 | 0.001 | 0.353 | 0.864 | 0.600 | 0.699 | 0.000 | 0.000 |
| rf~8 + 22 | 0.650 | 0.001 | 0.647 | 0.610 | 0.489 | 0.750 | 0.000 | 0.029 |
| knn~35 + 6 | 0.646 | 0.001 | 0.647 | 0.534 | 0.444 | 0.724 | 0.017 | 0.012 |
| rpart~8 + 28 | 0.646 | 0.001 | 0.574 | 0.678 | 0.506 | 0.734 | 0.000 | 0.079 |
| knn~37 + 6 | 0.647 | 0.001 | 0.721 | 0.432 | 0.422 | 0.729 | 0.032 | 0.006 |
| nb~43 + 6 | 0.650 | 0.001 | 0.382 | 0.797 | 0.520 | 0.691 | 0.002 | 0.052 |
| rpart~15 + 14 | 0.646 | 0.001 | 0.338 | 0.814 | 0.511 | 0.681 | 0.004 | 0.614 |
| nb~1 + 15 | 0.650 | 0.001 | 0.412 | 0.695 | 0.438 | 0.672 | 0.106 | 0.161 |
| nb~12 + 19 | 0.650 | 0.001 | 0.632 | 0.602 | 0.478 | 0.740 | 0.001 | 0.000 |
| svm~32 + 6 | 0.650 | 0.001 | 0.456 | 0.780 | 0.544 | 0.713 | 0.000 | 0.003 |
| rpart~18 + 8 | 0.644 | 0.001 | 0.588 | 0.686 | 0.519 | 0.743 | 0.000 | 0.047 |
| knn~38 + 22 | 0.648 | 0.001 | 0.559 | 0.644 | 0.475 | 0.717 | 0.002 | 0.007 |
| rpart~4 + 40 | 0.649 | 0.001 | 0.603 | 0.593 | 0.461 | 0.722 | 0.006 | 0.159 |
| nb~16 + 13 | 0.650 | 0.001 | 0.485 | 0.669 | 0.458 | 0.693 | 0.029 | 0.032 |
| nb~18 + 20 | 0.650 | 0.001 | 0.632 | 0.525 | 0.434 | 0.713 | 0.019 | 0.003 |
| svm~4 + 26 | 0.650 | 0.001 | 0.397 | 0.907 | 0.711 | 0.723 | 0.000 | 0.002 |
| svm~17 + 8 | 0.650 | 0.001 | 0.471 | 0.805 | 0.582 | 0.725 | 0.000 | 0.019 |
| nb~18 + 2 | 0.650 | 0.001 | 0.485 | 0.686 | 0.471 | 0.698 | 0.030 | 0.390 |
| rf~4 + 34 | 0.650 | 0.001 | 0.765 | 0.441 | 0.441 | 0.765 | 0.005 | 0.022 |
| rpart~9 + 20 | 0.643 | 0.001 | 0.721 | 0.500 | 0.454 | 0.756 | 0.003 | 0.055 |
| svm~17 + 13 | 0.650 | 0.001 | 0.441 | 0.729 | 0.484 | 0.694 | 0.008 | 0.020 |
| nb~15 + 14 | 0.650 | 0.001 | 0.324 | 0.831 | 0.524 | 0.681 | 0.003 | 0.310 |
| rpart~26 + 22 | 0.642 | 0.001 | 0.485 | 0.763 | 0.541 | 0.720 | 0.000 | 0.004 |
| knn~4 + 2 | 0.646 | 0.001 | 0.779 | 0.424 | 0.438 | 0.769 | 0.003 | 0.083 |
| nb~42 + 19 | 0.649 | 0.001 | 0.574 | 0.644 | 0.481 | 0.724 | 0.001 | 0.003 |
| svm~29 + 28 | 0.649 | 0.001 | 0.397 | 0.763 | 0.491 | 0.687 | 0.010 | 0.009 |
| nb~42 + 28 | 0.649 | 0.001 | 0.529 | 0.686 | 0.493 | 0.717 | 0.001 | 0.025 |
| knn~39 + 19 | 0.646 | 0.001 | 0.647 | 0.619 | 0.494 | 0.753 | 0.000 | 0.000 |
| rf~4 + 32 | 0.649 | 0.001 | 0.544 | 0.653 | 0.474 | 0.713 | 0.004 | 0.004 |
| svm~16 + 8 | 0.649 | 0.001 | 0.485 | 0.703 | 0.485 | 0.703 | 0.006 | 0.309 |
| svm~17 + 28 | 0.649 | 0.001 | 0.485 | 0.695 | 0.478 | 0.701 | 0.002 | 0.003 |
| svm~41 + 22 | 0.649 | 0.001 | 0.544 | 0.669 | 0.487 | 0.718 | 0.003 | 0.019 |
| rpart~14 + 20 | 0.634 | 0.001 | 0.735 | 0.551 | 0.485 | 0.783 | 0.000 | 0.001 |
| svm~16 + 13 | 0.649 | 0.001 | 0.471 | 0.686 | 0.464 | 0.692 | 0.027 | 0.069 |
| svm~28 + 32 | 0.649 | 0.001 | 0.441 | 0.771 | 0.526 | 0.705 | 0.000 | 0.006 |
| svm~19 + 21 | 0.648 | 0.001 | 0.500 | 0.763 | 0.548 | 0.726 | 0.000 | 0.004 |
| knn~42 + 18 | 0.643 | 0.001 | 0.632 | 0.602 | 0.478 | 0.740 | 0.004 | 0.016 |
| nb~38 + 22 | 0.648 | 0.001 | 0.529 | 0.695 | 0.500 | 0.719 | 0.001 | 0.060 |
| knn~4 + 41 | 0.645 | 0.001 | 0.456 | 0.746 | 0.508 | 0.704 | 0.002 | 0.007 |
| rpart~15 + 24 | 0.638 | 0.001 | 0.721 | 0.517 | 0.462 | 0.763 | 0.001 | 0.064 |
| rpart~10 + 28 | 0.640 | 0.001 | 0.441 | 0.746 | 0.500 | 0.698 | 0.011 | 0.086 |
| rf~15 + 41 | 0.648 | 0.001 | 0.603 | 0.703 | 0.539 | 0.755 | 0.000 | 0.701 |
| svm~33 + 22 | 0.648 | 0.001 | 0.544 | 0.610 | 0.446 | 0.699 | 0.024 | 0.061 |
| rpart~33 + 28 | 0.645 | 0.001 | 0.603 | 0.593 | 0.461 | 0.722 | 0.006 | 0.211 |
| rpart~2 + 22 | 0.640 | 0.001 | 0.706 | 0.508 | 0.453 | 0.750 | 0.003 | 0.125 |
| nb~17 + 9 | 0.648 | 0.001 | 0.559 | 0.703 | 0.521 | 0.735 | 0.000 | 0.044 |
| svm~16 + 29 | 0.648 | 0.001 | 0.368 | 0.873 | 0.625 | 0.705 | 0.000 | 0.005 |
| svm~37 + 28 | 0.648 | 0.001 | 0.603 | 0.627 | 0.482 | 0.733 | 0.001 | 0.035 |
| knn~32 + 6 | 0.645 | 0.001 | 0.500 | 0.653 | 0.453 | 0.694 | 0.024 | 0.008 |
| nb~16 + 8 | 0.648 | 0.001 | 0.500 | 0.686 | 0.479 | 0.704 | 0.012 | 0.042 |
| rpart~4 + 14 | 0.644 | 0.001 | 0.515 | 0.780 | 0.574 | 0.736 | 0.000 | 0.001 |
| knn~5 + 19 | 0.644 | 0.001 | 0.647 | 0.585 | 0.473 | 0.742 | 0.001 | 0.003 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~27 + 22 | 0.647 | 0.001 | 0.706 | 0.534 | 0.466 | 0.759 | 0.001 | 0.016 |
| svm~4 + 14 | 0.647 | 0.001 | 0.456 | 0.822 | 0.596 | 0.724 | 0.000 | 0.002 |
| nb~12 + 20 | 0.647 | 0.001 | 0.662 | 0.500 | 0.433 | 0.720 | 0.015 | 0.001 |
| svm~16 + 31 | 0.647 | 0.001 | 0.426 | 0.754 | 0.500 | 0.695 | 0.007 | 0.267 |
| nb~24 + 8 | 0.647 | 0.001 | 0.618 | 0.568 | 0.452 | 0.720 | 0.008 | 0.000 |
| nb~35 + 26 | 0.647 | 0.001 | 0.603 | 0.602 | 0.466 | 0.724 | 0.012 | 0.007 |
| rpart~18 + 22 | 0.638 | 0.001 | 0.426 | 0.771 | 0.518 | 0.700 | 0.002 | 0.049 |
| nb~16 + 40 | 0.647 | 0.001 | 0.500 | 0.720 | 0.507 | 0.714 | 0.003 | 0.173 |
| svm~18 + 6 | 0.647 | 0.001 | 0.456 | 0.737 | 0.500 | 0.702 | 0.003 | 0.046 |
| svm~7 + 6 | 0.647 | 0.001 | 0.618 | 0.653 | 0.506 | 0.748 | 0.000 | 0.025 |
| svm~40 + 17 | 0.647 | 0.001 | 0.603 | 0.644 | 0.494 | 0.738 | 0.000 | 0.059 |
| rpart~16 + 22 | 0.644 | 0.001 | 0.574 | 0.636 | 0.476 | 0.721 | 0.003 | 0.042 |
| rf~8 + 19 | 0.647 | 0.001 | 0.441 | 0.737 | 0.492 | 0.696 | 0.002 | 0.004 |
| nb~4 + 11 | 0.647 | 0.001 | 0.382 | 0.941 | 0.788 | 0.725 | 0.000 | 0.009 |
| nb~40 + 18 | 0.647 | 0.001 | 0.618 | 0.534 | 0.433 | 0.708 | 0.051 | 0.230 |
| nb~17 + 24 | 0.647 | 0.001 | 0.515 | 0.678 | 0.479 | 0.708 | 0.002 | 0.000 |
| svm~18 + 37 | 0.647 | 0.001 | 0.441 | 0.754 | 0.508 | 0.701 | 0.004 | 0.011 |
| nb~20 + 34 | 0.647 | 0.001 | 0.691 | 0.542 | 0.465 | 0.753 | 0.001 | 0.004 |
| svm~4 + 34 | 0.646 | 0.001 | 0.471 | 0.754 | 0.525 | 0.712 | 0.000 | 0.014 |
| nb~29 + 6 | 0.646 | 0.001 | 0.500 | 0.763 | 0.548 | 0.726 | 0.000 | 0.032 |
| rpart~25 + 19 | 0.640 | 0.001 | 0.647 | 0.542 | 0.449 | 0.727 | 0.005 | 0.014 |
| rpart~29 + 20 | 0.632 | 0.001 | 0.706 | 0.534 | 0.466 | 0.759 | 0.001 | 0.004 |
| rf~13 + 22 | 0.646 | 0.001 | 0.676 | 0.568 | 0.474 | 0.753 | 0.001 | 0.080 |
| nb~18 + 9 | 0.646 | 0.001 | 0.588 | 0.602 | 0.460 | 0.717 | 0.023 | 0.068 |
| svm~38 + 6 | 0.646 | 0.001 | 0.574 | 0.712 | 0.534 | 0.743 | 0.000 | 0.021 |
| rpart~4 + 26 | 0.644 | 0.001 | 0.485 | 0.678 | 0.465 | 0.696 | 0.016 | 0.005 |
| knn~17 + 22 | 0.643 | 0.001 | 0.559 | 0.661 | 0.487 | 0.722 | 0.001 | 0.036 |
| knn~37 + 22 | 0.643 | 0.001 | 0.750 | 0.432 | 0.432 | 0.750 | 0.014 | 0.001 |
| svm~18 + 13 | 0.646 | 0.001 | 0.559 | 0.661 | 0.487 | 0.722 | 0.002 | 0.006 |
| nb~43 + 22 | 0.646 | 0.001 | 0.691 | 0.559 | 0.475 | 0.759 | 0.001 | 0.054 |
| rpart~41 + 20 | 0.635 | 0.001 | 0.794 | 0.398 | 0.432 | 0.770 | 0.008 | 0.054 |
| knn~4 + 27 | 0.643 | 0.001 | 0.529 | 0.619 | 0.444 | 0.695 | 0.038 | 0.061 |
| svm~12 + 18 | 0.646 | 0.001 | 0.485 | 0.669 | 0.458 | 0.693 | 0.018 | 0.018 |
| svm~1 + 6 | 0.645 | 0.001 | 0.515 | 0.720 | 0.515 | 0.720 | 0.000 | 0.008 |
| svm~12 + 22 | 0.645 | 0.001 | 0.559 | 0.644 | 0.475 | 0.717 | 0.002 | 0.006 |
| svm~39 + 22 | 0.645 | 0.001 | 0.588 | 0.593 | 0.455 | 0.714 | 0.008 | 0.024 |
| nb~31 + 28 | 0.645 | 0.001 | 0.574 | 0.661 | 0.494 | 0.729 | 0.001 | 0.009 |
| svm~34 + 6 | 0.645 | 0.001 | 0.603 | 0.619 | 0.477 | 0.730 | 0.001 | 0.005 |
| knn~15 + 9 | 0.642 | 0.001 | 0.382 | 0.805 | 0.531 | 0.693 | 0.001 | 0.050 |
| nb~16 + 5 | 0.645 | 0.001 | 0.662 | 0.534 | 0.450 | 0.733 | 0.011 | 0.023 |
| rpart~17 + 22 | 0.640 | 0.001 | 0.515 | 0.669 | 0.473 | 0.705 | 0.007 | 0.390 |
| svm~4 + 11 | 0.645 | 0.001 | 0.441 | 0.873 | 0.667 | 0.730 | 0.000 | 0.004 |
| svm~32 + 22 | 0.645 | 0.001 | 0.456 | 0.737 | 0.500 | 0.702 | 0.002 | 0.002 |
| rf~4 + 7 | 0.645 | 0.001 | 0.588 | 0.610 | 0.465 | 0.720 | 0.009 | 0.016 |
| svm~35 + 24 | 0.645 | 0.001 | 0.279 | 0.873 | 0.559 | 0.678 | 0.005 | 0.031 |
| svm~7 + 19 | 0.645 | 0.001 | 0.691 | 0.551 | 0.470 | 0.756 | 0.001 | 0.017 |
| nb~35 + 18 | 0.645 | 0.001 | 0.559 | 0.602 | 0.447 | 0.703 | 0.036 | 0.086 |
| nb~17 + 37 | 0.645 | 0.001 | 0.618 | 0.661 | 0.512 | 0.750 | 0.000 | 0.111 |
| knn~20 + 6 | 0.642 | 0.001 | 0.676 | 0.525 | 0.451 | 0.738 | 0.005 | 0.001 |
| knn~4 + 6 | 0.641 | 0.001 | 0.544 | 0.737 | 0.544 | 0.737 | 0.000 | 0.003 |
| rf~24 + 19 | 0.644 | 0.001 | 0.515 | 0.703 | 0.500 | 0.716 | 0.000 | 0.000 |
| knn~4 + 32 | 0.642 | 0.001 | 0.618 | 0.653 | 0.506 | 0.748 | 0.000 | 0.077 |
| nb~26 + 2 | 0.644 | 0.001 | 0.397 | 0.771 | 0.500 | 0.689 | 0.018 | 0.213 |
| rpart~4 + 37 | 0.626 | 0.001 | 0.412 | 0.763 | 0.500 | 0.692 | 0.005 | 0.002 |
| nb~29 + 22 | 0.644 | 0.001 | 0.515 | 0.720 | 0.515 | 0.720 | 0.001 | 0.035 |
| nb~39 + 6 | 0.644 | 0.001 | 0.485 | 0.712 | 0.493 | 0.706 | 0.002 | 0.030 |
| rf~33 + 19 | 0.644 | 0.001 | 0.647 | 0.483 | 0.419 | 0.704 | 0.051 | 0.009 |
| nb~35 + 24 | 0.644 | 0.001 | 0.471 | 0.763 | 0.533 | 0.714 | 0.000 | 0.010 |
| rpart~1 + 19 | 0.639 | 0.001 | 0.632 | 0.602 | 0.478 | 0.740 | 0.000 | 0.003 |
| knn~4 + 14 | 0.642 | 0.001 | 0.529 | 0.712 | 0.514 | 0.724 | 0.000 | 0.005 |
| rf~12 + 31 | 0.644 | 0.001 | 0.588 | 0.551 | 0.430 | 0.699 | 0.045 | 0.144 |
| nb~15 + 36 | 0.644 | 0.001 | 0.500 | 0.754 | 0.540 | 0.724 | 0.000 | 0.267 |
| nb~36 + 19 | 0.644 | 0.001 | 0.706 | 0.542 | 0.471 | 0.762 | 0.000 | 0.003 |
| svm~27 + 22 | 0.644 | 0.001 | 0.588 | 0.636 | 0.482 | 0.728 | 0.002 | 0.023 |
| svm~1 + 28 | 0.644 | 0.001 | 0.515 | 0.780 | 0.574 | 0.736 | 0.000 | 0.003 |
| knn~4 + 9 | 0.641 | 0.001 | 0.529 | 0.712 | 0.514 | 0.724 | 0.000 | 0.007 |
| knn~4 + 36 | 0.641 | 0.001 | 0.721 | 0.373 | 0.398 | 0.698 | 0.099 | 0.002 |
| knn~39 + 22 | 0.641 | 0.001 | 0.632 | 0.627 | 0.494 | 0.747 | 0.000 | 0.161 |
| rpart~24 + 32 | 0.641 | 0.001 | 0.353 | 0.831 | 0.545 | 0.690 | 0.001 | 0.000 |
| rpart~12 + 18 | 0.642 | 0.001 | 0.618 | 0.551 | 0.442 | 0.714 | 0.022 | 0.039 |
| svm~16 + 21 | 0.643 | 0.001 | 0.559 | 0.669 | 0.494 | 0.725 | 0.001 | 0.442 |
| svm~17 + 6 | 0.643 | 0.001 | 0.471 | 0.712 | 0.485 | 0.700 | 0.004 | 0.012 |

TABLE 50-continued pairwise biomarkers from the 43 biomarker panel with significance for Wilcoxon P-value (auc.pvalue <= 0.001*) and other metrics for the MET event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~24 + 18 | 0.643 | 0.001 | 0.456 | 0.678 | 0.449 | 0.684 | 0.042 | 0.001 |
| nb~15 + 43 | 0.643 | 0.001 | 0.485 | 0.703 | 0.485 | 0.703 | 0.005 | 0.444 |
| svm~5 + 6 | 0.643 | 0.001 | 0.471 | 0.703 | 0.478 | 0.697 | 0.011 | 0.015 |
| knn~26 + 19 | 0.640 | 0.001 | 0.794 | 0.364 | 0.419 | 0.754 | 0.018 | 0.048 |
| nb~16 + 41 | 0.643 | 0.001 | 0.368 | 0.729 | 0.439 | 0.667 | 0.149 | 0.188 |
| rf~20 + 22 | 0.643 | 0.001 | 0.485 | 0.661 | 0.452 | 0.690 | 0.032 | 0.021 |
| knn~9 + 22 | 0.640 | 0.001 | 0.574 | 0.695 | 0.520 | 0.739 | 0.000 | 0.022 |
| nb~4 + 14 | 0.643 | 0.001 | 0.397 | 0.890 | 0.675 | 0.719 | 0.000 | 0.004 |
| nb~10 + 28 | 0.643 | 0.001 | 0.397 | 0.797 | 0.529 | 0.696 | 0.001 | 0.035 |
| rf~15 + 19 | 0.643 | 0.001 | 0.574 | 0.636 | 0.476 | 0.721 | 0.005 | 0.021 |
| nb~15 + 27 | 0.643 | 0.001 | 0.471 | 0.669 | 0.451 | 0.687 | 0.025 | 0.181 |
| nb~16 + 31 | 0.643 | 0.001 | 0.471 | 0.720 | 0.492 | 0.702 | 0.007 | 0.059 |
| knn~24 + 2 | 0.639 | 0.001 | 0.735 | 0.475 | 0.446 | 0.757 | 0.005 | 0.202 |
| knn~13 + 26 | 0.638 | 0.001 | 0.662 | 0.483 | 0.425 | 0.713 | 0.045 | 0.002 |
| knn~18 + 13 | 0.639 | 0.001 | 0.779 | 0.398 | 0.427 | 0.758 | 0.016 | 0.042 |
| svm~15 + 29 | 0.642 | 0.001 | 0.397 | 0.822 | 0.563 | 0.703 | 0.000 | 0.371 |
| svm~17 + 2 | 0.642 | 0.001 | 0.544 | 0.661 | 0.481 | 0.716 | 0.005 | 0.196 |
| knn~37 + 19 | 0.639 | 0.001 | 0.853 | 0.314 | 0.417 | 0.787 | 0.008 | 0.011 |
| rpart~18 + 28 | 0.641 | 0.001 | 0.485 | 0.729 | 0.508 | 0.711 | 0.001 | 0.016 |
| svm~42 + 22 | 0.642 | 0.001 | 0.559 | 0.636 | 0.469 | 0.714 | 0.004 | 0.027 |
| svm~33 + 28 | 0.642 | 0.001 | 0.588 | 0.568 | 0.440 | 0.705 | 0.040 | 0.015 |
| rpart~24 + 8 | 0.637 | 0.001 | 0.324 | 0.814 | 0.500 | 0.676 | 0.009 | 0.003 |
| svm~43 + 19 | 0.642 | 0.001 | 0.515 | 0.720 | 0.515 | 0.720 | 0.000 | 0.064 |
| nb~23 + 20 | 0.642 | 0.001 | 0.765 | 0.466 | 0.452 | 0.775 | 0.002 | 0.095 |
| nb~35 + 32 | 0.642 | 0.001 | 0.500 | 0.695 | 0.486 | 0.707 | 0.003 | 0.050 |
| svm~4 + 21 | 0.642 | 0.001 | 0.441 | 0.839 | 0.612 | 0.723 | 0.000 | 0.026 |
| rpart~24 + 2 | 0.637 | 0.001 | 0.382 | 0.856 | 0.605 | 0.706 | 0.000 | 0.005 |
| nb~15 + 38 | 0.642 | 0.001 | 0.412 | 0.746 | 0.483 | 0.688 | 0.018 | 0.369 |
| nb~7 + 6 | 0.642 | 0.001 | 0.515 | 0.695 | 0.493 | 0.713 | 0.002 | 0.077 |
| nb~8 + 26 | 0.642 | 0.001 | 0.750 | 0.381 | 0.411 | 0.726 | 0.068 | 0.003 |
| knn~4 + 37 | 0.639 | 0.001 | 0.779 | 0.390 | 0.424 | 0.754 | 0.011 | 0.006 |
| svm~15 + 7 | 0.642 | 0.001 | 0.456 | 0.712 | 0.477 | 0.694 | 0.010 | 0.662 |
| knn~15 + 24 | 0.637 | 0.001 | 0.632 | 0.542 | 0.443 | 0.719 | 0.019 | 0.072 |
| rf~1 + 22 | 0.641 | 0.001 | 0.632 | 0.610 | 0.483 | 0.742 | 0.001 | 0.010 |
| rpart~24 + 33 | 0.635 | 0.001 | 0.368 | 0.788 | 0.500 | 0.684 | 0.005 | 0.002 |
| rpart~8 + 6 | 0.639 | 0.001 | 0.529 | 0.703 | 0.507 | 0.722 | 0.001 | 0.016 |
| rpart~2 + 28 | 0.639 | 0.001 | 0.574 | 0.686 | 0.513 | 0.736 | 0.000 | 0.336 |
| svm~41 + 19 | 0.641 | 0.001 | 0.441 | 0.746 | 0.500 | 0.698 | 0.004 | 0.034 |
| rpart~1 + 2 | 0.640 | 0.001 | 0.529 | 0.712 | 0.514 | 0.724 | 0.002 | 0.188 |
| rpart~31 + 22 | 0.634 | 0.001 | 0.544 | 0.686 | 0.500 | 0.723 | 0.001 | 0.002 |
| svm~4 + 17 | 0.641 | 0.001 | 0.426 | 0.780 | 0.527 | 0.702 | 0.001 | 0.003 |
| rpart~16 + 10 | 0.628 | 0.001 | 0.515 | 0.763 | 0.556 | 0.732 | 0.000 | 0.033 |
| rpart~32 + 6 | 0.637 | 0.001 | 0.485 | 0.678 | 0.465 | 0.696 | 0.020 | 0.021 |
| rpart~16 + 33 | 0.640 | 0.001 | 0.603 | 0.636 | 0.488 | 0.735 | 0.001 | 0.732 |
| knn~4 + 11 | 0.637 | 0.001 | 0.441 | 0.771 | 0.526 | 0.705 | 0.001 | 0.014 |
| svm~14 + 19 | 0.641 | 0.001 | 0.471 | 0.712 | 0.485 | 0.700 | 0.002 | 0.006 |
| svm~35 + 18 | 0.641 | 0.001 | 0.382 | 0.754 | 0.473 | 0.679 | 0.053 | 0.027 |
| rpart~15 + 12 | 0.637 | 0.001 | 0.324 | 0.746 | 0.423 | 0.657 | 0.179 | 0.348 |
| rpart~4 + 33 | 0.639 | 0.001 | 0.618 | 0.568 | 0.452 | 0.720 | 0.009 | 0.007 |
| nb~28 + 34 | 0.641 | 0.001 | 0.574 | 0.653 | 0.488 | 0.726 | 0.001 | 0.009 |
| knn~28 + 21 | 0.636 | 0.001 | 0.779 | 0.398 | 0.427 | 0.758 | 0.015 | 0.017 |
| nb~17 + 2 | 0.640 | 0.001 | 0.529 | 0.686 | 0.493 | 0.717 | 0.004 | 0.465 |
| rpart~20 + 38 | 0.632 | 0.001 | 0.706 | 0.508 | 0.453 | 0.750 | 0.003 | 0.194 |
| rf~18 + 8 | 0.640 | 0.001 | 0.632 | 0.602 | 0.478 | 0.740 | 0.002 | 0.011 |
| svm~15 + 20 | 0.640 | 0.001 | 0.559 | 0.644 | 0.475 | 0.717 | 0.002 | 0.058 |
| nb~18 + 32 | 0.640 | 0.001 | 0.500 | 0.703 | 0.493 | 0.709 | 0.002 | 0.005 |
| rpart~14 + 22 | 0.633 | 0.001 | 0.441 | 0.754 | 0.508 | 0.701 | 0.001 | 0.013 |
| rf~15 + 20 | 0.640 | 0.001 | 0.647 | 0.559 | 0.458 | 0.733 | 0.009 | 0.512 |
| svm~41 + 28 | 0.640 | 0.001 | 0.471 | 0.669 | 0.451 | 0.687 | 0.043 | 0.013 |
| rf~19 + 3 | 0.640 | 0.001 | 0.603 | 0.619 | 0.477 | 0.730 | 0.001 | 0.001 | auc.pvalue: Wilcoxon Test P-value.
mfd: Median Fold Difference.
KM: Kaplan Meier curves.
MvaHRpval: Multivariable Analysis Hazard Ratio P-value.
*Multiple classifiers with p-values between 0.001 and 0.05 not included.

TABLE 51 pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~31 + 19 | 0.80 | 0.00 | 0.78 | 0.61 | 0.33 | 0.92 | 0.00 | 0.00 |
| nb~16 + 19 | 0.79 | 0.00 | 0.83 | 0.65 | 0.36 | 0.94 | 0.00 | 0.00 |
| svm~4 + 16 | 0.78 | 0.00 | 0.64 | 0.72 | 0.35 | 0.89 | 0.00 | 0.02 |
| nb~4 + 16 | 0.78 | 0.00 | 0.61 | 0.85 | 0.49 | 0.90 | 0.00 | 0.01 |
| svm~16 + 19 | 0.78 | 0.00 | 0.75 | 0.63 | 0.33 | 0.91 | 0.00 | 0.00 |
| nb~16 + 22 | 0.77 | 0.00 | 0.78 | 0.68 | 0.37 | 0.93 | 0.00 | 0.01 |
| nb~16 + 18 | 0.77 | 0.00 | 0.78 | 0.63 | 0.34 | 0.92 | 0.00 | 0.01 |
| svm~40 + 19 | 0.77 | 0.00 | 0.83 | 0.59 | 0.33 | 0.94 | 0.00 | 0.01 |
| nb~4 + 28 | 0.77 | 0.00 | 0.58 | 0.79 | 0.40 | 0.89 | 0.00 | 0.01 |
| svm~35 + 19 | 0.77 | 0.00 | 0.69 | 0.71 | 0.36 | 0.91 | 0.00 | 0.01 |
| nb~16 + 28 | 0.77 | 0.00 | 0.81 | 0.61 | 0.33 | 0.93 | 0.00 | 0.00 |
| nb~16 + 20 | 0.77 | 0.00 | 0.81 | 0.53 | 0.29 | 0.92 | 0.00 | 0.00 |
| nb~16 + 6 | 0.77 | 0.00 | 0.72 | 0.71 | 0.38 | 0.91 | 0.00 | 0.00 |
| rpart~4 + 16 | 0.76 | 0.00 | 0.72 | 0.68 | 0.35 | 0.91 | 0.00 | 0.04 |
| svm~39 + 19 | 0.77 | 0.00 | 0.81 | 0.59 | 0.32 | 0.93 | 0.00 | 0.00 |
| svm~16 + 28 | 0.77 | 0.00 | 0.67 | 0.73 | 0.38 | 0.90 | 0.00 | 0.04 |
| svm~16 + 18 | 0.77 | 0.00 | 0.75 | 0.73 | 0.40 | 0.92 | 0.00 | 0.01 |
| nb~40 + 28 | 0.76 | 0.00 | 0.83 | 0.63 | 0.35 | 0.94 | 0.00 | 0.01 |
| nb~28 + 6 | 0.76 | 0.00 | 0.75 | 0.69 | 0.37 | 0.92 | 0.00 | 0.00 |
| nb~40 + 19 | 0.76 | 0.00 | 0.86 | 0.52 | 0.30 | 0.94 | 0.00 | 0.01 |
| nb~12 + 28 | 0.76 | 0.00 | 0.81 | 0.65 | 0.35 | 0.93 | 0.00 | 0.00 |
| svm~43 + 19 | 0.76 | 0.00 | 0.69 | 0.71 | 0.37 | 0.91 | 0.00 | 0.00 |
| nb~43 + 19 | 0.76 | 0.00 | 0.94 | 0.51 | 0.32 | 0.97 | 0.00 | 0.00 |
| nb~4 + 24 | 0.76 | 0.00 | 0.53 | 0.87 | 0.49 | 0.88 | 0.00 | 0.00 |
| nb~24 + 28 | 0.76 | 0.00 | 0.58 | 0.73 | 0.34 | 0.88 | 0.00 | 0.00 |
| nb~15 + 28 | 0.76 | 0.00 | 0.58 | 0.77 | 0.38 | 0.89 | 0.00 | 0.01 |
| svm~13 + 22 | 0.76 | 0.00 | 0.81 | 0.66 | 0.36 | 0.93 | 0.00 | 0.04 |
| knn~16 + 18 | 0.75 | 0.00 | 0.92 | 0.37 | 0.26 | 0.95 | 0.00 | 0.02 |
| svm~4 + 24 | 0.76 | 0.00 | 0.56 | 0.83 | 0.44 | 0.89 | 0.00 | 0.00 |
| nb~19 + 28 | 0.76 | 0.00 | 0.81 | 0.63 | 0.34 | 0.93 | 0.00 | 0.00 |
| nb~4 + 12 | 0.75 | 0.00 | 0.64 | 0.79 | 0.42 | 0.90 | 0.00 | 0.01 |
| nb~28 + 22 | 0.75 | 0.00 | 0.75 | 0.66 | 0.35 | 0.92 | 0.00 | 0.01 |
| svm~16 + 22 | 0.75 | 0.00 | 0.75 | 0.63 | 0.33 | 0.91 | 0.00 | 0.02 |
| nb~12 + 22 | 0.75 | 0.00 | 0.75 | 0.67 | 0.35 | 0.92 | 0.00 | 0.01 |
| nb~4 + 35 | 0.75 | 0.00 | 0.61 | 0.85 | 0.49 | 0.90 | 0.00 | 0.03 |
| svm~29 + 19 | 0.75 | 0.00 | 0.69 | 0.68 | 0.34 | 0.90 | 0.00 | 0.00 |
| nb~35 + 19 | 0.75 | 0.00 | 0.81 | 0.53 | 0.29 | 0.92 | 0.00 | 0.01 |
| nb~4 + 19 | 0.75 | 0.00 | 0.61 | 0.78 | 0.40 | 0.89 | 0.00 | 0.01 |
| nb~16 + 24 | 0.75 | 0.00 | 0.67 | 0.70 | 0.35 | 0.90 | 0.00 | 0.00 |
| nb~20 + 28 | 0.75 | 0.00 | 0.75 | 0.59 | 0.30 | 0.91 | 0.00 | 0.00 |
| nb~18 + 28 | 0.75 | 0.00 | 0.64 | 0.65 | 0.31 | 0.88 | 0.00 | 0.01 |
| nb~43 + 6 | 0.75 | 0.00 | 0.47 | 0.78 | 0.34 | 0.86 | 0.00 | 0.01 |
| nb~35 + 6 | 0.75 | 0.00 | 0.61 | 0.74 | 0.36 | 0.89 | 0.00 | 0.01 |
| nb~35 + 20 | 0.75 | 0.00 | 0.89 | 0.41 | 0.26 | 0.94 | 0.00 | 0.00 |
| svm~8 + 22 | 0.75 | 0.00 | 0.67 | 0.71 | 0.36 | 0.90 | 0.00 | 0.01 |
| nb~16 + 26 | 0.75 | 0.00 | 0.58 | 0.73 | 0.34 | 0.88 | 0.00 | 0.00 |
| nb~12 + 6 | 0.75 | 0.00 | 0.78 | 0.63 | 0.33 | 0.92 | 0.00 | 0.01 |
| nb~40 + 24 | 0.74 | 0.00 | 0.64 | 0.63 | 0.29 | 0.88 | 0.00 | 0.00 |
| rpart~20 + 22 | 0.74 | 0.00 | 0.61 | 0.68 | 0.31 | 0.88 | 0.00 | 0.01 |
| nb~4 + 43 | 0.74 | 0.00 | 0.53 | 0.85 | 0.45 | 0.88 | 0.00 | 0.01 |
| nb~12 + 18 | 0.74 | 0.00 | 0.69 | 0.69 | 0.35 | 0.90 | 0.00 | 0.02 |
| svm~16 + 6 | 0.74 | 0.00 | 0.75 | 0.67 | 0.35 | 0.92 | 0.00 | 0.00 |
| svm~4 + 12 | 0.74 | 0.00 | 0.64 | 0.79 | 0.42 | 0.90 | 0.00 | 0.04 |
| rpart~8 + 28 | 0.74 | 0.00 | 0.75 | 0.67 | 0.35 | 0.92 | 0.00 | 0.01 |
| nb~40 + 22 | 0.74 | 0.00 | 0.72 | 0.56 | 0.28 | 0.89 | 0.00 | 0.07 |
| svm~13 + 28 | 0.74 | 0.00 | 0.64 | 0.65 | 0.30 | 0.88 | 0.00 | 0.02 |
| nb~26 + 28 | 0.74 | 0.00 | 0.67 | 0.66 | 0.32 | 0.89 | 0.00 | 0.00 |
| nb~40 + 6 | 0.74 | 0.00 | 0.61 | 0.74 | 0.36 | 0.89 | 0.00 | 0.03 |
| svm~12 + 6 | 0.74 | 0.00 | 0.67 | 0.68 | 0.33 | 0.89 | 0.00 | 0.00 |
| knn~24 + 22 | 0.73 | 0.00 | 0.67 | 0.76 | 0.40 | 0.90 | 0.00 | 0.04 |
| rpart~4 + 38 | 0.74 | 0.00 | 0.75 | 0.64 | 0.33 | 0.91 | 0.00 | 0.05 |
| svm~19 + 22 | 0.74 | 0.00 | 0.58 | 0.70 | 0.32 | 0.88 | 0.00 | 0.01 |
| svm~40 + 28 | 0.74 | 0.00 | 0.83 | 0.58 | 0.32 | 0.94 | 0.00 | 0.02 |
| rpart~4 + 24 | 0.73 | 0.00 | 0.56 | 0.79 | 0.39 | 0.88 | 0.00 | 0.01 |
| svm~19 + 28 | 0.74 | 0.00 | 0.69 | 0.71 | 0.36 | 0.91 | 0.00 | 0.00 |
| svm~4 + 31 | 0.74 | 0.00 | 0.69 | 0.68 | 0.34 | 0.90 | 0.00 | 0.04 |
| nb~4 + 20 | 0.74 | 0.00 | 0.69 | 0.72 | 0.37 | 0.91 | 0.00 | 0.01 |
| nb~4 + 15 | 0.74 | 0.00 | 0.56 | 0.79 | 0.39 | 0.88 | 0.00 | 0.03 |
| svm~33 + 19 | 0.74 | 0.00 | 0.64 | 0.60 | 0.28 | 0.87 | 0.00 | 0.00 |
| nb~24 + 22 | 0.74 | 0.00 | 0.72 | 0.59 | 0.30 | 0.90 | 0.00 | 0.00 |
| nb~12 + 19 | 0.74 | 0.00 | 0.75 | 0.58 | 0.30 | 0.91 | 0.00 | 0.00 |
| nb~4 + 23 | 0.74 | 0.00 | 0.61 | 0.77 | 0.39 | 0.89 | 0.00 | 0.06 |

TABLE 51-continued pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~4 + 31 | 0.74 | 0.00 | 0.56 | 0.79 | 0.38 | 0.88 | 0.00 | 0.03 |
| svm~13 + 19 | 0.74 | 0.00 | 0.83 | 0.50 | 0.29 | 0.93 | 0.00 | 0.03 |
| nb~4 + 6 | 0.74 | 0.00 | 0.58 | 0.77 | 0.38 | 0.88 | 0.00 | 0.04 |
| nb~43 + 28 | 0.74 | 0.00 | 0.69 | 0.68 | 0.34 | 0.90 | 0.00 | 0.00 |
| nb~28 + 32 | 0.74 | 0.00 | 0.67 | 0.63 | 0.30 | 0.89 | 0.00 | 0.02 |
| nb~19 + 6 | 0.74 | 0.00 | 0.61 | 0.74 | 0.36 | 0.89 | 0.00 | 0.00 |
| knn~4 + 16 | 0.73 | 0.00 | 0.78 | 0.59 | 0.31 | 0.92 | 0.00 | 0.02 |
| nb~13 + 22 | 0.74 | 0.00 | 0.75 | 0.67 | 0.35 | 0.92 | 0.00 | 0.07 |
| rf~31 + 19 | 0.74 | 0.00 | 0.81 | 0.53 | 0.29 | 0.92 | 0.00 | 0.00 |
| nb~43 + 22 | 0.74 | 0.00 | 0.83 | 0.54 | 0.30 | 0.93 | 0.00 | 0.02 |
| nb~4 + 8 | 0.73 | 0.00 | 0.53 | 0.87 | 0.50 | 0.89 | 0.00 | 0.03 |
| nb~4 + 32 | 0.73 | 0.00 | 0.61 | 0.82 | 0.45 | 0.90 | 0.00 | 0.05 |
| nb~4 + 40 | 0.73 | 0.00 | 0.58 | 0.87 | 0.53 | 0.90 | 0.00 | 0.04 |
| svm~4 + 13 | 0.73 | 0.00 | 0.61 | 0.83 | 0.46 | 0.90 | 0.00 | 0.01 |
| rpart~4 + 39 | 0.72 | 0.00 | 0.67 | 0.73 | 0.37 | 0.90 | 0.00 | 0.00 |
| svm~29 + 22 | 0.73 | 0.00 | 0.69 | 0.58 | 0.28 | 0.89 | 0.00 | 0.04 |
| nb~40 + 20 | 0.73 | 0.00 | 0.78 | 0.53 | 0.28 | 0.91 | 0.00 | 0.01 |
| nb~35 + 22 | 0.73 | 0.00 | 0.81 | 0.48 | 0.27 | 0.91 | 0.00 | 0.03 |
| rf~13 + 26 | 0.73 | 0.00 | 0.72 | 0.66 | 0.34 | 0.91 | 0.00 | 0.02 |
| svm~8 + 19 | 0.73 | 0.00 | 0.72 | 0.62 | 0.31 | 0.90 | 0.00 | 0.00 |
| nb~24 + 20 | 0.73 | 0.00 | 0.78 | 0.51 | 0.27 | 0.90 | 0.00 | 0.00 |
| nb~15 + 6 | 0.73 | 0.00 | 0.42 | 0.79 | 0.33 | 0.85 | 0.00 | 0.03 |
| svm~35 + 22 | 0.73 | 0.00 | 0.58 | 0.75 | 0.36 | 0.88 | 0.00 | 0.09 |
| nb~8 + 19 | 0.73 | 0.00 | 0.72 | 0.65 | 0.33 | 0.91 | 0.00 | 0.01 |
| nb~4 + 22 | 0.73 | 0.00 | 0.61 | 0.77 | 0.39 | 0.89 | 0.00 | 0.05 |
| svm~4 + 40 | 0.73 | 0.00 | 0.72 | 0.58 | 0.29 | 0.90 | 0.00 | 0.18 |
| svm~4 + 8 | 0.73 | 0.00 | 0.64 | 0.81 | 0.45 | 0.90 | 0.00 | 0.00 |
| nb~13 + 19 | 0.73 | 0.00 | 0.83 | 0.51 | 0.29 | 0.93 | 0.00 | 0.02 |
| svm~4 + 29 | 0.73 | 0.00 | 0.56 | 0.83 | 0.44 | 0.89 | 0.00 | 0.01 |
| svm~4 + 38 | 0.73 | 0.00 | 0.64 | 0.77 | 0.40 | 0.90 | 0.00 | 0.01 |
| nb~19 + 32 | 0.73 | 0.00 | 0.67 | 0.71 | 0.35 | 0.90 | 0.00 | 0.01 |
| nb~13 + 28 | 0.73 | 0.00 | 0.61 | 0.68 | 0.31 | 0.88 | 0.00 | 0.01 |
| nb~26 + 19 | 0.73 | 0.00 | 0.83 | 0.53 | 0.30 | 0.93 | 0.00 | 0.01 |
| nb~35 + 28 | 0.73 | 0.00 | 0.64 | 0.65 | 0.31 | 0.88 | 0.00 | 0.01 |
| nb~24 + 6 | 0.73 | 0.00 | 0.44 | 0.82 | 0.37 | 0.86 | 0.00 | 0.00 |
| svm~19 + 6 | 0.73 | 0.00 | 0.67 | 0.69 | 0.34 | 0.90 | 0.00 | 0.01 |
| nb~19 + 22 | 0.73 | 0.00 | 0.81 | 0.53 | 0.29 | 0.92 | 0.00 | 0.01 |
| nb~24 + 19 | 0.73 | 0.00 | 0.67 | 0.67 | 0.33 | 0.89 | 0.00 | 0.00 |
| nb~4 + 13 | 0.73 | 0.00 | 0.56 | 0.88 | 0.53 | 0.89 | 0.00 | 0.03 |
| svm~4 + 15 | 0.73 | 0.00 | 0.44 | 0.83 | 0.38 | 0.86 | 0.00 | 0.04 |
| nb~8 + 28 | 0.73 | 0.00 | 0.72 | 0.63 | 0.32 | 0.90 | 0.00 | 0.01 |
| svm~37 + 19 | 0.73 | 0.00 | 0.72 | 0.55 | 0.28 | 0.89 | 0.00 | 0.01 |
| nb~12 + 24 | 0.73 | 0.00 | 0.64 | 0.77 | 0.40 | 0.90 | 0.00 | 0.00 |
| nb~13 + 6 | 0.73 | 0.00 | 0.69 | 0.68 | 0.34 | 0.90 | 0.00 | 0.02 |
| nb~20 + 6 | 0.73 | 0.00 | 0.67 | 0.66 | 0.32 | 0.89 | 0.00 | 0.00 |
| svm~4 + 14 | 0.73 | 0.00 | 0.58 | 0.79 | 0.40 | 0.89 | 0.00 | 0.02 |
| knn~40 + 6 | 0.72 | 0.00 | 0.94 | 0.29 | 0.24 | 0.96 | 0.00 | 0.02 |
| nb~4 + 26 | 0.73 | 0.00 | 0.56 | 0.83 | 0.43 | 0.89 | 0.00 | 0.02 |
| nb~32 + 6 | 0.73 | 0.00 | 0.50 | 0.81 | 0.39 | 0.87 | 0.00 | 0.03 |
| svm~38 + 28 | 0.73 | 0.00 | 0.69 | 0.64 | 0.32 | 0.90 | 0.00 | 0.01 |
| rpart~13 + 6 | 0.72 | 0.00 | 0.72 | 0.67 | 0.34 | 0.91 | 0.00 | 0.05 |
| svm~4 + 35 | 0.73 | 0.00 | 0.61 | 0.77 | 0.39 | 0.89 | 0.00 | 0.05 |
| nb~4 + 18 | 0.73 | 0.00 | 0.58 | 0.74 | 0.35 | 0.88 | 0.00 | 0.05 |
| nb~12 + 26 | 0.73 | 0.00 | 0.58 | 0.77 | 0.38 | 0.89 | 0.00 | 0.01 |
| rf~24 + 22 | 0.73 | 0.00 | 0.69 | 0.67 | 0.34 | 0.90 | 0.00 | 0.02 |
| svm~19 + 38 | 0.73 | 0.00 | 0.72 | 0.63 | 0.32 | 0.90 | 0.00 | 0.02 |
| nb~19 + 20 | 0.73 | 0.00 | 0.78 | 0.49 | 0.27 | 0.90 | 0.00 | 0.01 |
| nb~31 + 28 | 0.73 | 0.00 | 0.78 | 0.66 | 0.35 | 0.93 | 0.00 | 0.00 |
| svm~40 + 24 | 0.73 | 0.00 | 0.78 | 0.63 | 0.33 | 0.92 | 0.00 | 0.02 |
| svm~12 + 28 | 0.73 | 0.00 | 0.64 | 0.68 | 0.32 | 0.89 | 0.00 | 0.08 |
| knn~18 + 32 | 0.72 | 0.00 | 0.89 | 0.39 | 0.26 | 0.94 | 0.00 | 0.03 |
| nb~4 + 33 | 0.72 | 0.00 | 0.56 | 0.85 | 0.48 | 0.89 | 0.00 | 0.07 |
| nb~31 + 19 | 0.72 | 0.00 | 0.75 | 0.67 | 0.35 | 0.92 | 0.00 | 0.01 |
| nb~8 + 22 | 0.72 | 0.00 | 0.78 | 0.57 | 0.30 | 0.91 | 0.00 | 0.06 |
| svm~14 + 19 | 0.72 | 0.00 | 0.58 | 0.70 | 0.32 | 0.88 | 0.00 | 0.01 |
| nb~32 + 22 | 0.72 | 0.00 | 0.67 | 0.61 | 0.29 | 0.88 | 0.00 | 0.05 |
| nb~4 + 36 | 0.72 | 0.00 | 0.50 | 0.89 | 0.51 | 0.88 | 0.00 | 0.03 |
| svm~40 + 6 | 0.72 | 0.00 | 0.81 | 0.55 | 0.30 | 0.92 | 0.00 | 0.08 |
| svm~39 + 22 | 0.72 | 0.00 | 0.75 | 0.59 | 0.31 | 0.91 | 0.00 | 0.03 |
| rpart~16 + 6 | 0.71 | 0.00 | 0.61 | 0.69 | 0.32 | 0.88 | 0.00 | 0.04 |
| knn~13 + 19 | 0.72 | 0.00 | 0.50 | 0.75 | 0.32 | 0.86 | 0.00 | 0.07 |
| rpart~4 + 31 | 0.72 | 0.00 | 0.75 | 0.66 | 0.35 | 0.92 | 0.00 | 0.04 |

TABLE 51-continued pairwise biomarkers from the 43 biomarker panel with significance for
Wilcoxon P-value (auc.pvalue <= 0.05) and other metrics for the
PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~13 + 6 | 0.72 | 0.00 | 0.69 | 0.69 | 0.35 | 0.90 | 0.00 | 0.04 |
| svm~4 + 42 | 0.72 | 0.00 | 0.69 | 0.64 | 0.32 | 0.90 | 0.00 | 0.09 |
| nb~12 + 20 | 0.72 | 0.00 | 0.75 | 0.49 | 0.26 | 0.89 | 0.00 | 0.00 |
| nb~22 + 6 | 0.72 | 0.00 | 0.64 | 0.66 | 0.31 | 0.88 | 0.00 | 0.02 |
| rpart~4 + 43 | 0.72 | 0.00 | 0.56 | 0.71 | 0.32 | 0.87 | 0.00 | 0.01 |
| rf~13 + 22 | 0.72 | 0.00 | 0.78 | 0.54 | 0.29 | 0.91 | 0.00 | 0.45 |
| nb~26 + 6 | 0.72 | 0.00 | 0.69 | 0.68 | 0.34 | 0.90 | 0.00 | 0.01 |
| svm~35 + 6 | 0.72 | 0.00 | 0.58 | 0.74 | 0.35 | 0.88 | 0.00 | 0.05 |
| nb~20 + 22 | 0.72 | 0.00 | 0.69 | 0.59 | 0.29 | 0.89 | 0.00 | 0.01 |
| rf~4 + 12 | 0.72 | 0.00 | 0.69 | 0.57 | 0.28 | 0.89 | 0.00 | 0.02 |
| nb~14 + 28 | 0.72 | 0.00 | 0.61 | 0.75 | 0.37 | 0.89 | 0.00 | 0.01 |
| rpart~24 + 38 | 0.71 | 0.00 | 0.61 | 0.77 | 0.39 | 0.89 | 0.00 | 0.00 |
| svm~4 + 28 | 0.72 | 0.00 | 0.61 | 0.74 | 0.36 | 0.89 | 0.00 | 0.04 |
| svm~24 + 13 | 0.72 | 0.00 | 0.42 | 0.83 | 0.38 | 0.86 | 0.00 | 0.02 |
| svm~19 + 21 | 0.72 | 0.00 | 0.64 | 0.74 | 0.37 | 0.90 | 0.00 | 0.01 |
| nb~18 + 6 | 0.72 | 0.00 | 0.64 | 0.68 | 0.32 | 0.89 | 0.00 | 0.02 |
| svm~13 + 26 | 0.72 | 0.00 | 0.53 | 0.86 | 0.48 | 0.88 | 0.00 | 0.18 |
| nb~17 + 28 | 0.72 | 0.00 | 0.64 | 0.67 | 0.32 | 0.88 | 0.00 | 0.00 |
| rpart~39 + 28 | 0.71 | 0.00 | 0.78 | 0.64 | 0.34 | 0.92 | 0.00 | 0.01 |
| nb~37 + 28 | 0.72 | 0.00 | 0.69 | 0.62 | 0.30 | 0.89 | 0.00 | 0.02 |
| nb~24 + 43 | 0.72 | 0.00 | 0.61 | 0.67 | 0.31 | 0.88 | 0.00 | 0.00 |
| rf~16 + 19 | 0.72 | 0.00 | 0.72 | 0.57 | 0.29 | 0.90 | 0.00 | 0.01 |
| svm~15 + 28 | 0.72 | 0.00 | 0.56 | 0.78 | 0.38 | 0.88 | 0.00 | 0.02 |
| svm~31 + 22 | 0.72 | 0.00 | 0.69 | 0.61 | 0.30 | 0.89 | 0.00 | 0.05 |
| rpart~31 + 19 | 0.71 | 0.00 | 0.86 | 0.54 | 0.31 | 0.94 | 0.00 | 0.01 |
| nb~16 + 17 | 0.72 | 0.00 | 0.61 | 0.75 | 0.37 | 0.89 | 0.00 | 0.02 |
| rpart~26 + 22 | 0.71 | 0.00 | 0.61 | 0.74 | 0.36 | 0.89 | 0.00 | 0.03 |
| svm~16 + 24 | 0.72 | 0.00 | 0.39 | 0.89 | 0.45 | 0.86 | 0.00 | 0.02 |
| svm~40 + 26 | 0.72 | 0.00 | 0.75 | 0.59 | 0.30 | 0.91 | 0.00 | 0.05 |
| nb~43 + 20 | 0.72 | 0.00 | 0.78 | 0.50 | 0.27 | 0.90 | 0.00 | 0.00 |
| svm~12 + 19 | 0.72 | 0.00 | 0.72 | 0.65 | 0.33 | 0.91 | 0.00 | 0.03 |
| rpart~24 + 32 | 0.71 | 0.00 | 0.50 | 0.83 | 0.41 | 0.87 | 0.00 | 0.02 |
| svm~31 + 28 | 0.72 | 0.00 | 0.81 | 0.63 | 0.34 | 0.93 | 0.00 | 0.01 |
| nb~20 + 32 | 0.72 | 0.00 | 0.75 | 0.53 | 0.28 | 0.90 | 0.00 | 0.02 |
| rpart~16 + 20 | 0.71 | 0.00 | 0.78 | 0.52 | 0.28 | 0.91 | 0.00 | 0.04 |
| rpart~4 + 13 | 0.71 | 0.00 | 0.64 | 0.67 | 0.32 | 0.89 | 0.00 | 0.04 |
| nb~24 + 26 | 0.72 | 0.00 | 0.72 | 0.67 | 0.34 | 0.91 | 0.00 | 0.00 |
| rpart~24 + 22 | 0.71 | 0.00 | 0.64 | 0.73 | 0.37 | 0.89 | 0.00 | 0.02 |
| rpart~8 + 19 | 0.71 | 0.00 | 0.75 | 0.62 | 0.32 | 0.91 | 0.00 | 0.00 |
| nb~15 + 22 | 0.72 | 0.00 | 0.50 | 0.74 | 0.32 | 0.86 | 0.00 | 0.06 |
| svm~28 + 32 | 0.72 | 0.00 | 0.53 | 0.75 | 0.33 | 0.87 | 0.00 | 0.09 |
| svm~4 + 41 | 0.72 | 0.00 | 0.42 | 0.82 | 0.36 | 0.85 | 0.00 | 0.01 |
| svm~4 + 19 | 0.72 | 0.00 | 0.81 | 0.68 | 0.38 | 0.94 | 0.00 | 0.02 |
| knn~12 + 22 | 0.71 | 0.00 | 0.67 | 0.68 | 0.33 | 0.89 | 0.00 | 0.05 |
| nb~16 + 32 | 0.72 | 0.00 | 0.64 | 0.71 | 0.34 | 0.89 | 0.00 | 0.06 |
| nb~26 + 22 | 0.72 | 0.00 | 0.78 | 0.57 | 0.30 | 0.91 | 0.00 | 0.03 |
| svm~12 + 18 | 0.72 | 0.00 | 0.67 | 0.68 | 0.33 | 0.89 | 0.00 | 0.05 |
| nb~8 + 6 | 0.72 | 0.00 | 0.58 | 0.72 | 0.33 | 0.88 | 0.00 | 0.03 |
| svm~18 + 19 | 0.72 | 0.00 | 0.72 | 0.64 | 0.33 | 0.91 | 0.00 | 0.01 |
| rf~33 + 19 | 0.72 | 0.00 | 0.75 | 0.48 | 0.26 | 0.89 | 0.01 | 0.00 |
| svm~26 + 19 | 0.72 | 0.00 | 0.64 | 0.76 | 0.39 | 0.90 | 0.00 | 0.01 |
| nb~15 + 16 | 0.72 | 0.00 | 0.53 | 0.73 | 0.32 | 0.87 | 0.00 | 0.05 |
| nb~42 + 6 | 0.71 | 0.00 | 0.61 | 0.75 | 0.37 | 0.89 | 0.00 | 0.04 |
| nb~18 + 22 | 0.71 | 0.00 | 0.81 | 0.59 | 0.32 | 0.93 | 0.00 | 0.05 |
| nb~14 + 19 | 0.71 | 0.00 | 0.81 | 0.45 | 0.26 | 0.91 | 0.00 | 0.01 |
| rpart~33 + 28 | 0.71 | 0.00 | 0.72 | 0.58 | 0.29 | 0.90 | 0.00 | 0.15 |
| svm~4 + 1 | 0.71 | 0.00 | 0.56 | 0.81 | 0.41 | 0.88 | 0.00 | 0.03 |
| svm~24 + 19 | 0.71 | 0.00 | 0.58 | 0.79 | 0.40 | 0.89 | 0.00 | 0.01 |
| nb~33 + 6 | 0.71 | 0.00 | 0.64 | 0.72 | 0.35 | 0.89 | 0.00 | 0.07 |
| nb~42 + 28 | 0.71 | 0.00 | 0.61 | 0.66 | 0.30 | 0.88 | 0.00 | 0.02 |
| knn~15 + 16 | 0.71 | 0.00 | 0.81 | 0.43 | 0.25 | 0.90 | 0.00 | 0.07 |
| svm~16 + 26 | 0.71 | 0.00 | 0.56 | 0.78 | 0.38 | 0.88 | 0.00 | 0.03 |
| rpart~24 + 28 | 0.71 | 0.00 | 0.44 | 0.77 | 0.31 | 0.85 | 0.00 | 0.02 |
| nb~31 + 6 | 0.71 | 0.00 | 0.64 | 0.71 | 0.34 | 0.89 | 0.00 | 0.01 |
| svm~12 + 22 | 0.71 | 0.00 | 0.67 | 0.63 | 0.30 | 0.89 | 0.00 | 0.08 |
| nb~15 + 19 | 0.71 | 0.00 | 0.53 | 0.77 | 0.36 | 0.87 | 0.00 | 0.03 |
| nb~18 + 19 | 0.71 | 0.00 | 0.72 | 0.57 | 0.29 | 0.89 | 0.00 | 0.02 |
| nb~23 + 20 | 0.71 | 0.00 | 0.89 | 0.45 | 0.28 | 0.94 | 0.00 | 0.01 |
| knn~4 + 32 | 0.71 | 0.00 | 0.78 | 0.63 | 0.34 | 0.92 | 0.00 | 0.37 |
| knn~40 + 19 | 0.71 | 0.00 | 0.83 | 0.48 | 0.28 | 0.92 | 0.00 | 0.02 |
| svm~15 + 19 | 0.71 | 0.00 | 0.47 | 0.81 | 0.37 | 0.86 | 0.00 | 0.07 |
| nb~4 + 41 | 0.71 | 0.00 | 0.53 | 0.79 | 0.38 | 0.88 | 0.00 | 0.05 |

TABLE 51-continued pairwise biomarkers from the 43 biomarker panel with significance for
Wilcoxon P-value (auc.pvalue <= 0.05) and other metrics for the
PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| rpart~18 + 22 | 0.70 | 0.00 | 0.53 | 0.75 | 0.34 | 0.87 | 0.00 | 0.12 |
| rf~13 + 19 | 0.71 | 0.00 | 0.89 | 0.35 | 0.25 | 0.93 | 0.01 | 0.05 |
| nb~15 + 24 | 0.71 | 0.00 | 0.58 | 0.73 | 0.34 | 0.88 | 0.00 | 0.01 |
| rpart~20 + 28 | 0.70 | 0.00 | 0.81 | 0.47 | 0.27 | 0.91 | 0.00 | 0.01 |
| knn~31 + 19 | 0.71 | 0.00 | 0.78 | 0.53 | 0.28 | 0.91 | 0.00 | 0.01 |
| svm~7 + 19 | 0.71 | 0.00 | 0.78 | 0.52 | 0.28 | 0.91 | 0.00 | 0.05 |
| rf~40 + 28 | 0.71 | 0.00 | 0.86 | 0.49 | 0.29 | 0.94 | 0.00 | 0.10 |
| knn~40 + 28 | 0.71 | 0.00 | 0.58 | 0.77 | 0.38 | 0.89 | 0.00 | 0.01 |
| rpart~4 + 32 | 0.71 | 0.00 | 0.61 | 0.71 | 0.33 | 0.88 | 0.00 | 0.19 |
| nb~4 + 42 | 0.71 | 0.00 | 0.53 | 0.83 | 0.43 | 0.88 | 0.00 | 0.07 |
| svm~8 + 28 | 0.71 | 0.00 | 0.69 | 0.65 | 0.32 | 0.90 | 0.00 | 0.02 |
| rf~12 + 19 | 0.71 | 0.00 | 0.64 | 0.66 | 0.31 | 0.88 | 0.00 | 0.01 |
| nb~42 + 22 | 0.71 | 0.00 | 0.72 | 0.51 | 0.26 | 0.88 | 0.01 | 0.16 |
| nb~4 + 11 | 0.71 | 0.00 | 0.47 | 0.89 | 0.52 | 0.88 | 0.00 | 0.09 |
| nb~40 + 18 | 0.71 | 0.00 | 0.75 | 0.53 | 0.28 | 0.90 | 0.00 | 0.16 |
| nb~15 + 32 | 0.71 | 0.00 | 0.33 | 0.84 | 0.33 | 0.84 | 0.00 | 0.15 |
| svm~4 + 32 | 0.71 | 0.00 | 0.61 | 0.73 | 0.35 | 0.89 | 0.00 | 0.13 |
| svm~29 + 28 | 0.71 | 0.00 | 0.47 | 0.75 | 0.31 | 0.85 | 0.00 | 0.02 |
| knn~16 + 19 | 0.71 | 0.00 | 0.81 | 0.59 | 0.32 | 0.93 | 0.00 | 0.00 |
| nb~4 + 29 | 0.71 | 0.00 | 0.58 | 0.73 | 0.34 | 0.88 | 0.00 | 0.10 |
| svm~4 + 39 | 0.71 | 0.00 | 0.64 | 0.69 | 0.33 | 0.89 | 0.00 | 0.00 |
| knn~18 + 13 | 0.71 | 0.00 | 0.89 | 0.39 | 0.26 | 0.94 | 0.00 | 0.43 |
| svm~19 + 32 | 0.71 | 0.00 | 0.61 | 0.75 | 0.37 | 0.89 | 0.00 | 0.01 |
| svm~28 + 22 | 0.71 | 0.00 | 0.64 | 0.73 | 0.37 | 0.89 | 0.00 | 0.01 |
| svm~8 + 6 | 0.71 | 0.00 | 0.67 | 0.67 | 0.33 | 0.89 | 0.00 | 0.02 |
| nb~4 + 14 | 0.71 | 0.00 | 0.50 | 0.85 | 0.45 | 0.88 | 0.00 | 0.03 |
| rf~24 + 13 | 0.71 | 0.00 | 0.64 | 0.57 | 0.26 | 0.87 | 0.01 | 0.01 |
| rf~9 + 19 | 0.71 | 0.00 | 0.83 | 0.57 | 0.32 | 0.93 | 0.00 | 0.00 |
| nb~41 + 28 | 0.71 | 0.00 | 0.67 | 0.59 | 0.28 | 0.88 | 0.00 | 0.02 |
| nb~42 + 19 | 0.71 | 0.00 | 0.69 | 0.63 | 0.31 | 0.90 | 0.00 | 0.04 |
| nb~4 + 1 | 0.71 | 0.00 | 0.58 | 0.79 | 0.40 | 0.89 | 0.00 | 0.05 |
| svm~1 + 19 | 0.71 | 0.00 | 0.69 | 0.61 | 0.30 | 0.89 | 0.00 | 0.00 |
| knn~35 + 19 | 0.70 | 0.00 | 0.89 | 0.39 | 0.26 | 0.94 | 0.00 | 0.00 |
| svm~4 + 11 | 0.71 | 0.00 | 0.53 | 0.83 | 0.42 | 0.88 | 0.00 | 0.04 |
| nb~18 + 32 | 0.71 | 0.00 | 0.61 | 0.69 | 0.32 | 0.88 | 0.00 | 0.12 |
| nb~24 + 32 | 0.71 | 0.00 | 0.42 | 0.89 | 0.48 | 0.86 | 0.00 | 0.01 |
| nb~33 + 28 | 0.71 | 0.00 | 0.72 | 0.57 | 0.29 | 0.90 | 0.00 | 0.02 |
| rpart~4 + 18 | 0.70 | 0.00 | 0.67 | 0.67 | 0.33 | 0.89 | 0.00 | 0.03 |
| svm~4 + 18 | 0.71 | 0.00 | 0.53 | 0.77 | 0.35 | 0.87 | 0.00 | 0.16 |
| svm~2 + 28 | 0.71 | 0.00 | 0.75 | 0.57 | 0.30 | 0.91 | 0.00 | 0.03 |
| svm~16 + 29 | 0.71 | 0.00 | 0.44 | 0.84 | 0.40 | 0.86 | 0.00 | 0.01 |
| nb~4 + 39 | 0.71 | 0.00 | 0.58 | 0.76 | 0.37 | 0.88 | 0.00 | 0.04 |
| svm~24 + 31 | 0.71 | 0.00 | 0.44 | 0.84 | 0.40 | 0.86 | 0.00 | 0.00 |
| svm~39 + 28 | 0.71 | 0.00 | 0.69 | 0.67 | 0.34 | 0.90 | 0.00 | 0.01 |
| nb~14 + 22 | 0.71 | 0.00 | 0.75 | 0.56 | 0.29 | 0.90 | 0.00 | 0.05 |
| knn~4 + 42 | 0.70 | 0.00 | 0.89 | 0.29 | 0.23 | 0.92 | 0.02 | 0.02 |
| knn~16 + 17 | 0.70 | 0.00 | 0.64 | 0.69 | 0.33 | 0.89 | 0.00 | 0.03 |
| svm~32 + 22 | 0.71 | 0.00 | 0.58 | 0.73 | 0.34 | 0.88 | 0.00 | 0.04 |
| rpart~14 + 28 | 0.68 | 0.00 | 0.53 | 0.80 | 0.39 | 0.88 | 0.00 | 0.07 |
| rpart~15 + 33 | 0.70 | 0.00 | 0.42 | 0.85 | 0.39 | 0.86 | 0.00 | 0.78 |
| rpart~14 + 24 | 0.70 | 0.00 | 0.47 | 0.79 | 0.35 | 0.86 | 0.00 | 0.02 |
| svm~42 + 19 | 0.71 | 0.00 | 0.58 | 0.69 | 0.31 | 0.87 | 0.00 | 0.11 |
| nb~18 + 20 | 0.71 | 0.00 | 0.72 | 0.51 | 0.26 | 0.89 | 0.00 | 0.02 |
| rpart~4 + 42 | 0.70 | 0.00 | 0.75 | 0.58 | 0.30 | 0.91 | 0.00 | 0.12 |
| svm~12 + 24 | 0.71 | 0.00 | 0.39 | 0.87 | 0.41 | 0.86 | 0.00 | 0.04 |
| rpart~32 + 22 | 0.70 | 0.00 | 0.61 | 0.73 | 0.35 | 0.89 | 0.00 | 0.17 |
| nb~4 + 25 | 0.71 | 0.00 | 0.64 | 0.77 | 0.40 | 0.90 | 0.00 | 0.14 |
| nb~24 + 18 | 0.71 | 0.00 | 0.56 | 0.67 | 0.29 | 0.86 | 0.00 | 0.01 |
| svm~43 + 6 | 0.71 | 0.00 | 0.47 | 0.77 | 0.33 | 0.86 | 0.00 | 0.03 |
| rpart~4 + 11 | 0.67 | 0.00 | 0.53 | 0.77 | 0.35 | 0.87 | 0.00 | 0.04 |
| nb~4 + 37 | 0.71 | 0.00 | 0.58 | 0.79 | 0.40 | 0.89 | 0.00 | 0.06 |
| svm~19 + 3 | 0.71 | 0.00 | 0.56 | 0.77 | 0.37 | 0.88 | 0.00 | 0.13 |
| rpart~33 + 19 | 0.67 | 0.00 | 0.67 | 0.68 | 0.33 | 0.89 | 0.00 | 0.01 |
| nb~37 + 22 | 0.71 | 0.00 | 0.67 | 0.59 | 0.28 | 0.88 | 0.00 | 0.11 |
| nb~8 + 20 | 0.71 | 0.00 | 0.75 | 0.47 | 0.25 | 0.89 | 0.01 | 0.01 |
| rpart~12 + 24 | 0.70 | 0.00 | 0.47 | 0.83 | 0.40 | 0.87 | 0.00 | 0.00 |
| rpart~9 + 19 | 0.69 | 0.00 | 0.78 | 0.53 | 0.28 | 0.91 | 0.00 | 0.01 |
| nb~4 + 38 | 0.70 | 0.00 | 0.67 | 0.74 | 0.38 | 0.90 | 0.00 | 0.02 |
| svm~17 + 19 | 0.70 | 0.00 | 0.56 | 0.72 | 0.32 | 0.87 | 0.00 | 0.01 |
| nb~4 + 9 | 0.70 | 0.00 | 0.61 | 0.78 | 0.40 | 0.89 | 0.00 | 0.06 |
| nb~23 + 6 | 0.70 | 0.00 | 0.58 | 0.72 | 0.33 | 0.88 | 0.00 | 0.03 |
| rpart~25 + 19 | 0.69 | 0.00 | 0.78 | 0.53 | 0.29 | 0.91 | 0.00 | 0.02 |

TABLE 51-continued pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| knn~4 + 12 | 0.70 | 0.00 | 0.53 | 0.82 | 0.41 | 0.88 | 0.00 | 0.07 |
| nb~17 + 6 | 0.70 | 0.00 | 0.67 | 0.63 | 0.30 | 0.89 | 0.00 | 0.01 |
| svm~31 + 6 | 0.70 | 0.00 | 0.67 | 0.65 | 0.31 | 0.89 | 0.00 | 0.03 |
| svm~21 + 22 | 0.70 | 0.00 | 0.58 | 0.69 | 0.31 | 0.87 | 0.00 | 0.07 |
| rpart~14 + 22 | 0.69 | 0.00 | 0.53 | 0.73 | 0.32 | 0.87 | 0.00 | 0.05 |
| nb~37 + 19 | 0.70 | 0.00 | 0.61 | 0.65 | 0.29 | 0.87 | 0.00 | 0.01 |
| nb~26 + 20 | 0.70 | 0.00 | 0.75 | 0.52 | 0.27 | 0.90 | 0.00 | 0.01 |
| rpart~40 + 26 | 0.69 | 0.00 | 0.64 | 0.63 | 0.29 | 0.88 | 0.01 | 0.03 |
| svm~26 + 22 | 0.70 | 0.00 | 0.61 | 0.70 | 0.33 | 0.88 | 0.00 | 0.04 |
| svm~24 + 26 | 0.70 | 0.00 | 0.31 | 0.92 | 0.48 | 0.85 | 0.00 | 0.00 |
| svm~28 + 6 | 0.70 | 0.00 | 0.64 | 0.71 | 0.34 | 0.89 | 0.00 | 0.00 |
| nb~40 + 26 | 0.70 | 0.00 | 0.78 | 0.47 | 0.26 | 0.90 | 0.01 | 0.08 |
| rpart~42 + 22 | 0.69 | 0.00 | 0.67 | 0.59 | 0.28 | 0.88 | 0.00 | 0.36 |
| nb~36 + 6 | 0.70 | 0.00 | 0.58 | 0.73 | 0.34 | 0.88 | 0.00 | 0.02 |
| nb~36 + 22 | 0.70 | 0.00 | 0.72 | 0.55 | 0.28 | 0.89 | 0.00 | 0.08 |
| nb~16 + 40 | 0.70 | 0.00 | 0.58 | 0.69 | 0.31 | 0.87 | 0.00 | 0.09 |
| svm~18 + 6 | 0.70 | 0.00 | 0.56 | 0.72 | 0.32 | 0.87 | 0.00 | 0.08 |
| nb~41 + 6 | 0.70 | 0.00 | 0.53 | 0.78 | 0.37 | 0.87 | 0.00 | 0.05 |
| svm~16 + 31 | 0.70 | 0.00 | 0.53 | 0.74 | 0.33 | 0.87 | 0.00 | 0.15 |
| nb~12 + 17 | 0.70 | 0.00 | 0.53 | 0.77 | 0.36 | 0.87 | 0.00 | 0.02 |
| nb~36 + 28 | 0.70 | 0.00 | 0.72 | 0.59 | 0.30 | 0.90 | 0.00 | 0.01 |
| rpart~16 + 19 | 0.69 | 0.00 | 0.83 | 0.56 | 0.31 | 0.93 | 0.00 | 0.00 |
| knn~40 + 24 | 0.70 | 0.00 | 0.86 | 0.41 | 0.26 | 0.93 | 0.00 | 0.01 |
| svm~37 + 22 | 0.70 | 0.00 | 0.69 | 0.59 | 0.29 | 0.89 | 0.00 | 0.51 |
| rpart~24 + 5 | 0.70 | 0.00 | 0.58 | 0.72 | 0.33 | 0.88 | 0.00 | 0.01 |
| rf~4 + 39 | 0.70 | 0.00 | 0.75 | 0.57 | 0.29 | 0.90 | 0.00 | 0.00 |
| nb~4 + 34 | 0.70 | 0.00 | 0.53 | 0.80 | 0.39 | 0.88 | 0.00 | 0.05 |
| nb~17 + 19 | 0.70 | 0.00 | 0.78 | 0.56 | 0.30 | 0.91 | 0.00 | 0.01 |
| rf~16 + 18 | 0.70 | 0.00 | 0.67 | 0.62 | 0.30 | 0.89 | 0.00 | 0.19 |
| svm~14 + 22 | 0.70 | 0.00 | 0.53 | 0.68 | 0.28 | 0.86 | 0.01 | 0.06 |
| svm~18 + 28 | 0.70 | 0.00 | 0.64 | 0.69 | 0.33 | 0.89 | 0.00 | 0.01 |
| rpart~7 + 20 | 0.69 | 0.00 | 0.81 | 0.45 | 0.26 | 0.91 | 0.00 | 0.03 |
| svm~42 + 6 | 0.70 | 0.00 | 0.67 | 0.63 | 0.30 | 0.89 | 0.00 | 0.03 |
| nb~4 + 27 | 0.70 | 0.00 | 0.67 | 0.66 | 0.32 | 0.89 | 0.00 | 0.07 |
| nb~11 + 6 | 0.70 | 0.00 | 0.50 | 0.81 | 0.39 | 0.87 | 0.00 | 0.06 |
| rf~35 + 19 | 0.70 | 0.00 | 0.72 | 0.61 | 0.31 | 0.90 | 0.00 | 0.01 |
| svm~26 + 28 | 0.70 | 0.00 | 0.53 | 0.77 | 0.36 | 0.87 | 0.00 | 0.02 |
| nb~1 + 28 | 0.70 | 0.00 | 0.61 | 0.69 | 0.32 | 0.88 | 0.00 | 0.01 |
| nb~11 + 28 | 0.70 | 0.00 | 0.56 | 0.71 | 0.31 | 0.87 | 0.00 | 0.05 |
| rf~4 + 32 | 0.70 | 0.00 | 0.64 | 0.63 | 0.29 | 0.88 | 0.00 | 0.23 |
| rpart~4 + 26 | 0.70 | 0.00 | 0.58 | 0.67 | 0.30 | 0.87 | 0.00 | 0.02 |
| nb~13 + 20 | 0.70 | 0.00 | 0.69 | 0.57 | 0.28 | 0.89 | 0.00 | 0.02 |
| nb~37 + 6 | 0.70 | 0.00 | 0.69 | 0.65 | 0.32 | 0.90 | 0.00 | 0.08 |
| svm~25 + 28 | 0.70 | 0.00 | 0.72 | 0.59 | 0.30 | 0.90 | 0.00 | 0.09 |
| svm~40 + 18 | 0.70 | 0.00 | 0.72 | 0.55 | 0.28 | 0.89 | 0.00 | 0.10 |
| nb~14 + 20 | 0.70 | 0.00 | 0.78 | 0.51 | 0.28 | 0.91 | 0.00 | 0.01 |
| knn~32 + 22 | 0.70 | 0.00 | 0.64 | 0.69 | 0.33 | 0.89 | 0.00 | 0.06 |
| rpart~19 + 20 | 0.69 | 0.00 | 0.81 | 0.47 | 0.27 | 0.91 | 0.00 | 0.02 |
| rf~4 + 31 | 0.70 | 0.00 | 0.61 | 0.64 | 0.29 | 0.87 | 0.00 | 0.05 |
| rpart~4 + 28 | 0.70 | 0.00 | 0.58 | 0.73 | 0.34 | 0.88 | 0.00 | 0.03 |
| svm~24 + 22 | 0.70 | 0.00 | 0.42 | 0.83 | 0.38 | 0.86 | 0.00 | 0.05 |
| knn~4 + 19 | 0.70 | 0.00 | 0.72 | 0.65 | 0.33 | 0.91 | 0.00 | 0.07 |
| nb~4 + 17 | 0.70 | 0.00 | 0.58 | 0.79 | 0.40 | 0.89 | 0.00 | 0.05 |
| svm~12 + 16 | 0.70 | 0.00 | 0.39 | 0.87 | 0.42 | 0.86 | 0.00 | 0.08 |
| rpart~4 + 1 | 0.69 | 0.00 | 0.69 | 0.51 | 0.25 | 0.87 | 0.01 | 0.09 |
| svm~24 + 6 | 0.70 | 0.00 | 0.56 | 0.77 | 0.37 | 0.88 | 0.00 | 0.03 |
| knn~39 + 22 | 0.70 | 0.00 | 0.78 | 0.61 | 0.32 | 0.92 | 0.00 | 0.38 |
| rpart~4 + 23 | 0.69 | 0.00 | 0.67 | 0.67 | 0.33 | 0.89 | 0.00 | 0.03 |
| svm~29 + 6 | 0.70 | 0.00 | 0.64 | 0.71 | 0.35 | 0.89 | 0.00 | 0.01 |
| knn~4 + 31 | 0.69 | 0.00 | 0.61 | 0.67 | 0.31 | 0.88 | 0.00 | 0.01 |
| knn~35 + 28 | 0.69 | 0.00 | 0.89 | 0.43 | 0.27 | 0.94 | 0.00 | 0.12 |
| nb~4 + 2 | 0.70 | 0.00 | 0.64 | 0.71 | 0.35 | 0.89 | 0.00 | 0.15 |
| nb~17 + 22 | 0.70 | 0.00 | 0.69 | 0.53 | 0.26 | 0.88 | 0.01 | 0.04 |
| nb~26 + 32 | 0.70 | 0.00 | 0.67 | 0.59 | 0.28 | 0.88 | 0.00 | 0.05 |
| knn~29 + 6 | 0.69 | 0.00 | 0.61 | 0.67 | 0.31 | 0.88 | 0.00 | 0.03 |
| svm~38 + 22 | 0.70 | 0.00 | 0.67 | 0.65 | 0.31 | 0.89 | 0.00 | 0.11 |
| svm~34 + 22 | 0.70 | 0.00 | 0.64 | 0.53 | 0.25 | 0.86 | 0.03 | 0.01 |
| nb~33 + 19 | 0.70 | 0.00 | 0.81 | 0.53 | 0.29 | 0.92 | 0.00 | 0.05 |
| rpart~31 + 22 | 0.69 | 0.00 | 0.64 | 0.66 | 0.31 | 0.88 | 0.00 | 0.01 |
| svm~12 + 32 | 0.70 | 0.00 | 0.44 | 0.83 | 0.38 | 0.86 | 0.00 | 0.10 |
| rpart~28 + 34 | 0.69 | 0.00 | 0.56 | 0.66 | 0.28 | 0.86 | 0.00 | 0.06 |
| knn~4 + 34 | 0.69 | 0.00 | 0.81 | 0.39 | 0.24 | 0.89 | 0.02 | 0.15 |

TABLE 51-continued pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| svm~21 + 6 | 0.70 | 0.00 | 0.61 | 0.65 | 0.30 | 0.88 | 0.00 | 0.02 |
| nb~15 + 20 | 0.70 | 0.00 | 0.75 | 0.57 | 0.30 | 0.91 | 0.00 | 0.02 |
| svm~4 + 43 | 0.70 | 0.00 | 0.50 | 0.83 | 0.42 | 0.87 | 0.00 | 0.01 |
| knn~12 + 19 | 0.69 | 0.00 | 0.67 | 0.59 | 0.28 | 0.88 | 0.00 | 0.01 |
| rpart~24 + 31 | 0.69 | 0.00 | 0.47 | 0.83 | 0.40 | 0.87 | 0.00 | 0.00 |
| svm~4 + 6 | 0.70 | 0.00 | 0.64 | 0.73 | 0.37 | 0.89 | 0.00 | 0.14 |
| nb~14 + 6 | 0.70 | 0.00 | 0.64 | 0.74 | 0.37 | 0.90 | 0.00 | 0.02 |
| rpart~40 + 18 | 0.69 | 0.00 | 0.81 | 0.45 | 0.26 | 0.91 | 0.01 | 0.07 |
| rf~4 + 38 | 0.70 | 0.00 | 0.58 | 0.67 | 0.30 | 0.87 | 0.00 | 0.07 |
| rpart~23 + 19 | 0.69 | 0.00 | 0.81 | 0.45 | 0.26 | 0.91 | 0.00 | 0.01 |
| rpart~18 + 32 | 0.69 | 0.00 | 0.69 | 0.62 | 0.30 | 0.89 | 0.00 | 0.11 |
| svm~1 + 22 | 0.70 | 0.00 | 0.58 | 0.73 | 0.34 | 0.88 | 0.00 | 0.02 |
| svm~4 + 22 | 0.70 | 0.00 | 0.64 | 0.73 | 0.36 | 0.89 | 0.00 | 0.16 |
| rpart~4 + 6 | 0.69 | 0.00 | 0.61 | 0.65 | 0.30 | 0.88 | 0.00 | 0.11 |
| svm~4 + 25 | 0.70 | 0.00 | 0.67 | 0.62 | 0.30 | 0.89 | 0.00 | 0.33 |
| svm~42 + 22 | 0.70 | 0.00 | 0.64 | 0.61 | 0.28 | 0.88 | 0.00 | 0.07 |
| nb~16 + 43 | 0.70 | 0.00 | 0.58 | 0.67 | 0.30 | 0.87 | 0.01 | 0.01 |
| knn~4 + 20 | 0.69 | 0.00 | 0.72 | 0.53 | 0.27 | 0.89 | 0.00 | 0.02 |
| svm~19 + 34 | 0.70 | 0.00 | 0.75 | 0.61 | 0.31 | 0.91 | 0.00 | 0.00 |
| svm~4 + 21 | 0.70 | 0.00 | 0.58 | 0.81 | 0.43 | 0.89 | 0.00 | 0.11 |
| rf~12 + 22 | 0.70 | 0.00 | 0.64 | 0.66 | 0.31 | 0.88 | 0.00 | 0.04 |
| rpart~4 + 17 | 0.69 | 0.00 | 0.58 | 0.67 | 0.30 | 0.87 | 0.00 | 0.02 |
| knn~17 + 22 | 0.69 | 0.00 | 0.67 | 0.64 | 0.31 | 0.89 | 0.00 | 0.11 |
| rf~24 + 19 | 0.70 | 0.00 | 0.58 | 0.67 | 0.30 | 0.87 | 0.00 | 0.00 |
| nb~9 + 6 | 0.70 | 0.00 | 0.69 | 0.57 | 0.28 | 0.89 | 0.00 | 0.07 |
| svm~9 + 19 | 0.70 | 0.00 | 0.78 | 0.59 | 0.31 | 0.92 | 0.00 | 0.01 |
| rpart~4 + 29 | 0.69 | 0.00 | 0.64 | 0.65 | 0.30 | 0.88 | 0.00 | 0.01 |
| svm~27 + 19 | 0.69 | 0.00 | 0.67 | 0.59 | 0.28 | 0.88 | 0.00 | 0.03 |
| svm~13 + 32 | 0.69 | 0.00 | 0.47 | 0.79 | 0.35 | 0.86 | 0.00 | 0.31 |
| svm~36 + 28 | 0.69 | 0.00 | 0.61 | 0.64 | 0.29 | 0.87 | 0.00 | 0.02 |
| svm~11 + 28 | 0.69 | 0.00 | 0.61 | 0.69 | 0.32 | 0.88 | 0.00 | 0.46 |
| nb~28 + 34 | 0.69 | 0.00 | 0.61 | 0.61 | 0.28 | 0.87 | 0.00 | 0.01 |
| nb~18 + 43 | 0.69 | 0.00 | 0.61 | 0.67 | 0.31 | 0.88 | 0.00 | 0.09 |
| rf~4 + 16 | 0.69 | 0.00 | 0.75 | 0.55 | 0.29 | 0.90 | 0.00 | 0.21 |
| svm~15 + 22 | 0.69 | 0.00 | 0.50 | 0.77 | 0.35 | 0.87 | 0.00 | 0.05 |
| nb~28 + 21 | 0.69 | 0.00 | 0.53 | 0.71 | 0.30 | 0.86 | 0.00 | 0.00 |
| rf~38 + 28 | 0.69 | 0.00 | 0.69 | 0.58 | 0.28 | 0.89 | 0.00 | 0.47 |
| svm~4 + 33 | 0.69 | 0.00 | 0.64 | 0.69 | 0.33 | 0.89 | 0.00 | 0.04 |
| nb~4 + 3 | 0.69 | 0.00 | 0.50 | 0.81 | 0.39 | 0.87 | 0.00 | 0.10 |
| rpart~28 + 22 | 0.68 | 0.00 | 0.67 | 0.62 | 0.30 | 0.89 | 0.00 | 0.12 |
| svm~1 + 28 | 0.69 | 0.00 | 0.61 | 0.74 | 0.36 | 0.89 | 0.00 | 0.00 |
| knn~13 + 26 | 0.69 | 0.00 | 0.75 | 0.47 | 0.25 | 0.89 | 0.01 | 0.08 |
| nb~40 + 32 | 0.69 | 0.00 | 0.64 | 0.65 | 0.31 | 0.88 | 0.00 | 0.31 |
| rf~26 + 22 | 0.69 | 0.00 | 0.67 | 0.62 | 0.30 | 0.89 | 0.00 | 0.12 |
| svm~15 + 40 | 0.69 | 0.00 | 0.58 | 0.65 | 0.29 | 0.87 | 0.01 | 0.85 |
| knn~4 + 43 | 0.69 | 0.00 | 0.58 | 0.69 | 0.31 | 0.87 | 0.00 | 0.08 |
| rf~40 + 24 | 0.69 | 0.00 | 0.67 | 0.62 | 0.30 | 0.89 | 0.00 | 0.03 |
| nb~12 + 16 | 0.69 | 0.00 | 0.58 | 0.73 | 0.34 | 0.88 | 0.00 | 0.05 |
| rf~4 + 13 | 0.69 | 0.00 | 0.56 | 0.74 | 0.34 | 0.87 | 0.00 | 0.09 |
| knn~24 + 13 | 0.69 | 0.00 | 0.81 | 0.52 | 0.29 | 0.92 | 0.00 | 0.06 |
| knn~4 + 37 | 0.69 | 0.00 | 0.86 | 0.37 | 0.25 | 0.92 | 0.01 | 0.02 |
| rf~4 + 14 | 0.69 | 0.00 | 0.64 | 0.65 | 0.31 | 0.88 | 0.00 | 0.01 |
| rpart~16 + 18 | 0.65 | 0.00 | 0.47 | 0.82 | 0.39 | 0.87 | 0.00 | 0.03 |
| nb~34 + 6 | 0.69 | 0.00 | 0.56 | 0.67 | 0.29 | 0.86 | 0.00 | 0.03 |
| svm~12 + 13 | 0.69 | 0.00 | 0.31 | 0.83 | 0.31 | 0.83 | 0.03 | 0.07 |
| nb~16 + 13 | 0.69 | 0.00 | 0.58 | 0.66 | 0.29 | 0.87 | 0.01 | 0.20 |
| svm~39 + 6 | 0.69 | 0.00 | 0.61 | 0.73 | 0.35 | 0.89 | 0.00 | 0.07 |
| knn~24 + 43 | 0.69 | 0.00 | 0.67 | 0.57 | 0.27 | 0.88 | 0.02 | 0.00 |
| nb~42 + 20 | 0.69 | 0.00 | 0.72 | 0.52 | 0.27 | 0.89 | 0.00 | 0.04 |
| svm~28 + 21 | 0.69 | 0.00 | 0.64 | 0.72 | 0.35 | 0.89 | 0.00 | 0.02 |
| svm~14 + 28 | 0.69 | 0.00 | 0.53 | 0.76 | 0.35 | 0.87 | 0.00 | 0.05 |
| rpart~17 + 22 | 0.68 | 0.00 | 0.58 | 0.65 | 0.28 | 0.87 | 0.00 | 0.41 |
| nb~9 + 19 | 0.69 | 0.00 | 0.78 | 0.55 | 0.29 | 0.91 | 0.00 | 0.02 |
| rpart~25 + 22 | 0.69 | 0.00 | 0.72 | 0.50 | 0.26 | 0.88 | 0.01 | 0.22 |
| nb~9 + 22 | 0.69 | 0.00 | 0.58 | 0.69 | 0.31 | 0.87 | 0.00 | 0.12 |
| svm~43 + 22 | 0.69 | 0.00 | 0.53 | 0.73 | 0.32 | 0.87 | 0.00 | 0.04 |
| svm~18 + 32 | 0.69 | 0.00 | 0.58 | 0.68 | 0.30 | 0.87 | 0.00 | 0.23 |
| rpart~39 + 19 | 0.68 | 0.00 | 0.83 | 0.44 | 0.26 | 0.92 | 0.00 | 0.01 |
| nb~39 + 6 | 0.69 | 0.00 | 0.56 | 0.69 | 0.30 | 0.87 | 0.00 | 0.04 |
| rpart~24 + 20 | 0.68 | 0.00 | 0.67 | 0.69 | 0.34 | 0.90 | 0.00 | 0.01 |
| nb~38 + 28 | 0.69 | 0.00 | 0.61 | 0.66 | 0.30 | 0.88 | 0.00 | 0.02 |
| nb~16 + 31 | 0.69 | 0.00 | 0.56 | 0.70 | 0.31 | 0.87 | 0.00 | 0.11 |

TABLE 51-continued pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| rpart~20 + 38 | 0.68 | 0.00 | 0.78 | 0.48 | 0.26 | 0.90 | 0.00 | 0.07 |
| rpart~4 + 40 | 0.69 | 0.00 | 0.67 | 0.57 | 0.27 | 0.88 | 0.01 | 0.25 |
| rpart~24 + 19 | 0.68 | 0.00 | 0.69 | 0.57 | 0.28 | 0.89 | 0.00 | 0.01 |
| nb~11 + 22 | 0.69 | 0.00 | 0.83 | 0.52 | 0.29 | 0.93 | 0.00 | 0.13 |
| knn~37 + 6 | 0.69 | 0.00 | 0.81 | 0.42 | 0.25 | 0.90 | 0.01 | 0.01 |
| knn~13 + 22 | 0.69 | 0.00 | 0.89 | 0.37 | 0.25 | 0.93 | 0.00 | 0.33 |
| nb~4 + 7 | 0.69 | 0.00 | 0.56 | 0.75 | 0.34 | 0.88 | 0.00 | 0.08 |
| nb~25 + 6 | 0.69 | 0.00 | 0.56 | 0.73 | 0.33 | 0.87 | 0.00 | 0.16 |
| knn~28 + 21 | 0.68 | 0.00 | 0.92 | 0.39 | 0.27 | 0.95 | 0.00 | 0.05 |
| nb~15 + 12 | 0.69 | 0.00 | 0.56 | 0.69 | 0.30 | 0.87 | 0.00 | 0.06 |
| nb~33 + 22 | 0.69 | 0.00 | 0.78 | 0.47 | 0.26 | 0.90 | 0.01 | 0.17 |
| svm~3 + 28 | 0.69 | 0.00 | 0.39 | 0.81 | 0.33 | 0.85 | 0.00 | 0.17 |
| nb~12 + 32 | 0.69 | 0.00 | 0.64 | 0.69 | 0.33 | 0.89 | 0.00 | 0.05 |
| nb~27 + 28 | 0.69 | 0.00 | 0.78 | 0.54 | 0.29 | 0.91 | 0.00 | 0.03 |
| nb~39 + 28 | 0.69 | 0.00 | 0.44 | 0.71 | 0.27 | 0.84 | 0.03 | 0.01 |
| nb~3 + 6 | 0.69 | 0.00 | 0.42 | 0.81 | 0.35 | 0.85 | 0.00 | 0.05 |
| knn~12 + 6 | 0.69 | 0.00 | 0.64 | 0.67 | 0.32 | 0.88 | 0.00 | 0.02 |
| nb~15 + 26 | 0.69 | 0.00 | 0.53 | 0.73 | 0.32 | 0.87 | 0.00 | 0.11 |
| nb~16 + 14 | 0.69 | 0.00 | 0.61 | 0.71 | 0.33 | 0.88 | 0.00 | 0.05 |
| rf~19 + 3 | 0.69 | 0.00 | 0.69 | 0.59 | 0.29 | 0.89 | 0.00 | 0.00 |
| svm~33 + 28 | 0.69 | 0.00 | 0.69 | 0.56 | 0.27 | 0.88 | 0.00 | 0.04 |
| nb~23 + 19 | 0.69 | 0.00 | 0.67 | 0.64 | 0.31 | 0.89 | 0.00 | 0.04 |
| svm~30 + 19 | 0.69 | 0.00 | 0.64 | 0.63 | 0.29 | 0.88 | 0.00 | 0.00 |
| rpart~13 + 26 | 0.68 | 0.00 | 0.61 | 0.75 | 0.37 | 0.89 | 0.00 | 0.07 |
| svm~23 + 6 | 0.69 | 0.00 | 0.58 | 0.70 | 0.32 | 0.88 | 0.00 | 0.01 |
| svm~12 + 26 | 0.69 | 0.00 | 0.47 | 0.83 | 0.40 | 0.87 | 0.00 | 0.10 |
| svm~24 + 38 | 0.69 | 0.00 | 0.42 | 0.83 | 0.37 | 0.86 | 0.00 | 0.00 |
| rpart~4 + 25 | 0.69 | 0.00 | 0.78 | 0.50 | 0.27 | 0.90 | 0.00 | 0.03 |
| svm~33 + 22 | 0.69 | 0.00 | 0.67 | 0.61 | 0.29 | 0.88 | 0.00 | 0.08 |
| rpart~43 + 19 | 0.69 | 0.00 | 0.72 | 0.59 | 0.30 | 0.90 | 0.00 | 0.01 |
| nb~17 + 24 | 0.69 | 0.00 | 0.67 | 0.67 | 0.33 | 0.89 | 0.00 | 0.00 |
| nb~36 + 19 | 0.69 | 0.00 | 0.81 | 0.51 | 0.28 | 0.92 | 0.00 | 0.02 |
| rpart~37 + 28 | 0.68 | 0.00 | 0.69 | 0.61 | 0.30 | 0.89 | 0.00 | 0.16 |
| knn~37 + 22 | 0.68 | 0.00 | 0.86 | 0.42 | 0.26 | 0.93 | 0.00 | 0.01 |
| knn~33 + 19 | 0.68 | 0.00 | 0.44 | 0.78 | 0.33 | 0.85 | 0.00 | 0.07 |
| nb~9 + 28 | 0.69 | 0.00 | 0.53 | 0.68 | 0.28 | 0.86 | 0.01 | 0.03 |
| svm~34 + 6 | 0.69 | 0.00 | 0.72 | 0.60 | 0.30 | 0.90 | 0.00 | 0.00 |
| rf~4 + 43 | 0.69 | 0.00 | 0.69 | 0.62 | 0.30 | 0.89 | 0.00 | 0.08 |
| nb~25 + 28 | 0.69 | 0.00 | 0.58 | 0.67 | 0.30 | 0.87 | 0.00 | 0.04 |
| knn~24 + 19 | 0.68 | 0.00 | 0.89 | 0.35 | 0.25 | 0.93 | 0.00 | 0.02 |
| svm~2 + 19 | 0.69 | 0.00 | 0.72 | 0.47 | 0.25 | 0.88 | 0.02 | 0.06 |
| nb~21 + 6 | 0.69 | 0.00 | 0.61 | 0.69 | 0.32 | 0.88 | 0.00 | 0.02 |
| rpart~1 + 19 | 0.68 | 0.00 | 0.75 | 0.58 | 0.30 | 0.91 | 0.00 | 0.01 |
| nb~1 + 6 | 0.69 | 0.00 | 0.56 | 0.73 | 0.33 | 0.87 | 0.00 | 0.03 |
| svm~16 + 21 | 0.69 | 0.00 | 0.58 | 0.63 | 0.27 | 0.86 | 0.01 | 0.05 |
| svm~33 + 6 | 0.69 | 0.00 | 0.58 | 0.67 | 0.30 | 0.87 | 0.00 | 0.09 |
| rpart~16 + 22 | 0.68 | 0.00 | 0.64 | 0.61 | 0.28 | 0.88 | 0.00 | 0.28 |
| svm~4 + 26 | 0.69 | 0.00 | 0.50 | 0.87 | 0.47 | 0.88 | 0.00 | 0.04 |
| rpart~8 + 26 | 0.68 | 0.00 | 0.42 | 0.83 | 0.38 | 0.86 | 0.00 | 0.00 |
| knn~29 + 32 | 0.68 | 0.00 | 0.83 | 0.38 | 0.24 | 0.90 | 0.01 | 0.02 |
| rpart~26 + 28 | 0.68 | 0.00 | 0.56 | 0.73 | 0.33 | 0.87 | 0.00 | 0.01 |
| nb~15 + 18 | 0.69 | 0.00 | 0.58 | 0.71 | 0.32 | 0.88 | 0.00 | 0.15 |
| rf~39 + 24 | 0.69 | 0.00 | 0.72 | 0.54 | 0.27 | 0.89 | 0.00 | 0.01 |
| nb~33 + 20 | 0.69 | 0.00 | 0.89 | 0.37 | 0.25 | 0.93 | 0.00 | 0.02 |
| svm~29 + 18 | 0.69 | 0.00 | 0.36 | 0.81 | 0.31 | 0.84 | 0.02 | 0.10 |
| knn~39 + 24 | 0.68 | 0.00 | 0.75 | 0.59 | 0.30 | 0.91 | 0.00 | 0.00 |
| nb~11 + 20 | 0.69 | 0.00 | 0.78 | 0.45 | 0.25 | 0.89 | 0.01 | 0.03 |
| svm~40 + 22 | 0.69 | 0.00 | 0.78 | 0.45 | 0.25 | 0.89 | 0.02 | 0.27 |
| svm~16 + 32 | 0.69 | 0.00 | 0.50 | 0.78 | 0.35 | 0.87 | 0.00 | 0.26 |
| nb~25 + 19 | 0.69 | 0.00 | 0.67 | 0.65 | 0.32 | 0.89 | 0.00 | 0.12 |
| rf~4 + 24 | 0.69 | 0.00 | 0.64 | 0.64 | 0.30 | 0.88 | 0.00 | 0.02 |
| nb~27 + 6 | 0.69 | 0.00 | 0.64 | 0.60 | 0.28 | 0.87 | 0.00 | 0.05 |
| svm~12 + 40 | 0.69 | 0.00 | 0.61 | 0.60 | 0.27 | 0.87 | 0.05 | 0.12 |
| knn~17 + 19 | 0.68 | 0.00 | 0.44 | 0.79 | 0.34 | 0.86 | 0.00 | 0.04 |
| nb~13 + 26 | 0.69 | 0.00 | 0.78 | 0.48 | 0.26 | 0.90 | 0.01 | 0.24 |
| rpart~41 + 20 | 0.67 | 0.00 | 0.83 | 0.37 | 0.24 | 0.90 | 0.01 | 0.04 |
| knn~35 + 22 | 0.68 | 0.00 | 0.75 | 0.50 | 0.26 | 0.89 | 0.01 | 0.22 |
| rpart~24 + 33 | 0.68 | 0.00 | 0.44 | 0.77 | 0.32 | 0.85 | 0.00 | 0.01 |
| nb~16 + 8 | 0.69 | 0.00 | 0.58 | 0.67 | 0.30 | 0.87 | 0.01 | 0.13 |
| nb~17 + 43 | 0.69 | 0.00 | 0.56 | 0.69 | 0.30 | 0.87 | 0.00 | 0.05 |
| nb~12 + 40 | 0.69 | 0.00 | 0.53 | 0.71 | 0.30 | 0.86 | 0.01 | 0.07 |
| rf~4 + 19 | 0.68 | 0.00 | 0.64 | 0.63 | 0.29 | 0.88 | 0.00 | 0.05 |

TABLE 51-continued pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~18 + 13 | 0.68 | 0.00 | 0.69 | 0.54 | 0.27 | 0.88 | 0.01 | 0.48 |
| nb~23 + 22 | 0.68 | 0.00 | 0.67 | 0.65 | 0.31 | 0.89 | 0.00 | 0.07 |
| rpart~1 + 22 | 0.67 | 0.00 | 0.42 | 0.79 | 0.33 | 0.85 | 0.00 | 0.09 |
| svm~17 + 6 | 0.68 | 0.00 | 0.56 | 0.69 | 0.30 | 0.87 | 0.00 | 0.04 |
| nb~7 + 6 | 0.68 | 0.00 | 0.56 | 0.66 | 0.28 | 0.86 | 0.01 | 0.05 |
| nb~4 + 30 | 0.68 | 0.00 | 0.56 | 0.78 | 0.38 | 0.88 | 0.00 | 0.02 |
| rpart~12 + 32 | 0.68 | 0.00 | 0.69 | 0.69 | 0.35 | 0.90 | 0.00 | 0.53 |
| rpart~35 + 6 | 0.68 | 0.00 | 0.56 | 0.69 | 0.30 | 0.87 | 0.00 | 0.26 |
| svm~24 + 28 | 0.68 | 0.00 | 0.36 | 0.89 | 0.43 | 0.85 | 0.00 | 0.02 |
| knn~43 + 22 | 0.68 | 0.00 | 0.81 | 0.45 | 0.26 | 0.91 | 0.00 | 0.01 |
| nb~34 + 22 | 0.68 | 0.00 | 0.67 | 0.55 | 0.26 | 0.87 | 0.01 | 0.07 |
| nb~29 + 6 | 0.68 | 0.00 | 0.61 | 0.73 | 0.35 | 0.89 | 0.00 | 0.07 |
| nb~21 + 22 | 0.68 | 0.00 | 0.69 | 0.61 | 0.30 | 0.89 | 0.00 | 0.03 |
| nb~29 + 28 | 0.68 | 0.00 | 0.61 | 0.67 | 0.31 | 0.88 | 0.00 | 0.05 |
| rpart~14 + 20 | 0.67 | 0.00 | 0.78 | 0.50 | 0.27 | 0.90 | 0.00 | 0.01 |
| rpart~29 + 20 | 0.67 | 0.00 | 0.78 | 0.50 | 0.27 | 0.90 | 0.00 | 0.01 |
| nb~10 + 6 | 0.68 | 0.00 | 0.50 | 0.81 | 0.39 | 0.87 | 0.00 | 0.05 |
| nb~41 + 22 | 0.68 | 0.00 | 0.64 | 0.59 | 0.27 | 0.87 | 0.01 | 0.14 |
| nb~23 + 28 | 0.68 | 0.00 | 0.47 | 0.75 | 0.31 | 0.85 | 0.01 | 0.02 |
| svm~43 + 28 | 0.68 | 0.00 | 0.58 | 0.72 | 0.33 | 0.88 | 0.00 | 0.01 |
| knn~4 + 13 | 0.68 | 0.00 | 0.67 | 0.69 | 0.34 | 0.90 | 0.00 | 0.59 |
| nb~17 + 32 | 0.68 | 0.00 | 0.67 | 0.67 | 0.33 | 0.89 | 0.00 | 0.10 |
| svm~37 + 6 | 0.68 | 0.00 | 0.69 | 0.62 | 0.30 | 0.89 | 0.00 | 0.14 |
| svm~7 + 28 | 0.68 | 0.00 | 0.58 | 0.60 | 0.26 | 0.86 | 0.03 | 0.26 |
| svm~32 + 6 | 0.68 | 0.00 | 0.58 | 0.76 | 0.37 | 0.88 | 0.00 | 0.01 |
| nb~31 + 22 | 0.68 | 0.00 | 0.72 | 0.55 | 0.28 | 0.89 | 0.00 | 0.06 |
| svm~38 + 6 | 0.68 | 0.00 | 0.64 | 0.67 | 0.32 | 0.88 | 0.00 | 0.03 |
| nb~11 + 19 | 0.68 | 0.00 | 0.69 | 0.62 | 0.30 | 0.89 | 0.00 | 0.07 |
| nb~19 + 21 | 0.68 | 0.00 | 0.72 | 0.61 | 0.31 | 0.90 | 0.00 | 0.01 |
| rpart~4 + 8 | 0.68 | 0.00 | 0.69 | 0.62 | 0.30 | 0.89 | 0.00 | 0.02 |
| nb~15 + 43 | 0.68 | 0.00 | 0.56 | 0.68 | 0.29 | 0.86 | 0.01 | 0.08 |
| svm~22 + 6 | 0.68 | 0.00 | 0.53 | 0.73 | 0.32 | 0.87 | 0.00 | 0.03 |
| nb~24 + 31 | 0.68 | 0.00 | 0.53 | 0.76 | 0.35 | 0.87 | 0.00 | 0.00 |
| svm~28 + 34 | 0.68 | 0.00 | 0.58 | 0.65 | 0.29 | 0.87 | 0.00 | 0.16 |
| rpart~4 + 37 | 0.66 | 0.00 | 0.53 | 0.75 | 0.34 | 0.87 | 0.00 | 0.01 |
| rf~4 + 40 | 0.68 | 0.00 | 0.69 | 0.49 | 0.25 | 0.87 | 0.04 | 0.07 |
| svm~25 + 6 | 0.68 | 0.00 | 0.67 | 0.55 | 0.26 | 0.87 | 0.01 | 0.22 |
| svm~42 + 16 | 0.68 | 0.00 | 0.47 | 0.73 | 0.29 | 0.85 | 0.02 | 0.12 |
| nb~2 + 28 | 0.68 | 0.00 | 0.56 | 0.63 | 0.27 | 0.86 | 0.02 | 0.04 |
| svm~35 + 28 | 0.68 | 0.00 | 0.50 | 0.79 | 0.36 | 0.87 | 0.00 | 0.39 |
| nb~3 + 28 | 0.68 | 0.00 | 0.47 | 0.71 | 0.28 | 0.85 | 0.01 | 0.04 |
| svm~12 + 39 | 0.68 | 0.00 | 0.36 | 0.81 | 0.31 | 0.84 | 0.02 | 0.12 |
| rf~4 + 42 | 0.68 | 0.00 | 0.64 | 0.61 | 0.28 | 0.88 | 0.01 | 0.20 |
| nb~29 + 22 | 0.68 | 0.00 | 0.58 | 0.69 | 0.31 | 0.87 | 0.00 | 0.18 |
| nb~10 + 28 | 0.68 | 0.00 | 0.47 | 0.77 | 0.33 | 0.86 | 0.00 | 0.06 |
| svm~11 + 22 | 0.68 | 0.00 | 0.61 | 0.69 | 0.32 | 0.88 | 0.00 | 0.40 |
| rpart~24 + 34 | 0.67 | 0.00 | 0.36 | 0.89 | 0.43 | 0.85 | 0.00 | 0.00 |
| rf~32 + 22 | 0.68 | 0.00 | 0.61 | 0.65 | 0.29 | 0.87 | 0.00 | 0.25 |
| rf~24 + 28 | 0.68 | 0.00 | 0.61 | 0.61 | 0.27 | 0.87 | 0.01 | 0.02 |
| nb~1 + 22 | 0.68 | 0.00 | 0.64 | 0.57 | 0.26 | 0.87 | 0.01 | 0.08 |
| nb~36 + 20 | 0.68 | 0.00 | 0.78 | 0.55 | 0.29 | 0.91 | 0.00 | 0.01 |
| knn~15 + 22 | 0.68 | 0.00 | 0.81 | 0.46 | 0.26 | 0.91 | 0.00 | 0.32 |
| svm~10 + 6 | 0.68 | 0.00 | 0.56 | 0.75 | 0.35 | 0.88 | 0.00 | 0.06 |
| nb~10 + 22 | 0.68 | 0.00 | 0.69 | 0.51 | 0.26 | 0.88 | 0.02 | 0.23 |
| nb~19 + 34 | 0.68 | 0.00 | 0.69 | 0.66 | 0.33 | 0.90 | 0.00 | 0.01 |
| svm~17 + 28 | 0.68 | 0.00 | 0.56 | 0.67 | 0.29 | 0.86 | 0.00 | 0.02 |
| svm~37 + 28 | 0.68 | 0.00 | 0.67 | 0.59 | 0.28 | 0.88 | 0.00 | 0.08 |
| nb~4 + 21 | 0.68 | 0.00 | 0.58 | 0.81 | 0.43 | 0.89 | 0.00 | 0.03 |
| nb~37 + 20 | 0.68 | 0.00 | 0.64 | 0.59 | 0.27 | 0.87 | 0.00 | 0.01 |
| svm~42 + 28 | 0.68 | 0.00 | 0.81 | 0.59 | 0.32 | 0.93 | 0.00 | 0.26 |
| knn~4 + 40 | 0.67 | 0.00 | 0.75 | 0.51 | 0.27 | 0.90 | 0.01 | 0.23 |
| knn~12 + 40 | 0.67 | 0.00 | 0.75 | 0.57 | 0.30 | 0.91 | 0.00 | 0.22 |
| nb~18 + 26 | 0.68 | 0.00 | 0.69 | 0.63 | 0.31 | 0.90 | 0.00 | 0.12 |
| rpart~15 + 24 | 0.67 | 0.00 | 0.78 | 0.48 | 0.26 | 0.90 | 0.00 | 0.08 |
| nb~15 + 40 | 0.68 | 0.00 | 0.42 | 0.81 | 0.35 | 0.85 | 0.00 | 0.30 |
| svm~10 + 19 | 0.68 | 0.00 | 0.64 | 0.67 | 0.32 | 0.89 | 0.00 | 0.01 |
| svm~12 + 29 | 0.68 | 0.00 | 0.44 | 0.79 | 0.34 | 0.86 | 0.00 | 0.01 |
| rpart~4 + 33 | 0.68 | 0.00 | 0.67 | 0.54 | 0.26 | 0.87 | 0.02 | 0.00 |
| rpart~24 + 25 | 0.67 | 0.00 | 0.50 | 0.75 | 0.33 | 0.86 | 0.00 | 0.00 |
| knn~15 + 19 | 0.67 | 0.00 | 0.89 | 0.38 | 0.26 | 0.93 | 0.00 | 0.06 |
| knn~8 + 6 | 0.67 | 0.00 | 0.75 | 0.49 | 0.26 | 0.89 | 0.01 | 0.01 |
| nb~39 + 22 | 0.68 | 0.00 | 0.72 | 0.47 | 0.25 | 0.88 | 0.02 | 0.08 |

TABLE 51-continued pairwise biomarkers from the 43 biomarker panel with significance for Wilcoxon P-value (auc.pvalue <= 0.05) and other metrics for the PCSM event endpoint.

| Classifier | auc | auc. pvalue | Sensitivity | Specificity | Pos. Pred. Value | Neg. Pred. Value | KM P-value | Mva HRPval |
|---|---|---|---|---|---|---|---|---|
| nb~31 + 20 | 0.68 | 0.00 | 0.72 | 0.49 | 0.25 | 0.88 | 0.01 | 0.01 |
| rpart~13 + 22 | 0.68 | 0.00 | 0.78 | 0.52 | 0.28 | 0.91 | 0.00 | 0.36 |
| knn~4 + 38 | 0.67 | 0.00 | 0.75 | 0.43 | 0.24 | 0.88 | 0.03 | 0.04 |
| rf~15 + 28 | 0.68 | 0.00 | 0.69 | 0.56 | 0.27 | 0.88 | 0.00 | 0.17 |
| svm~9 + 22 | 0.68 | 0.00 | 0.56 | 0.72 | 0.32 | 0.87 | 0.00 | 0.16 |
| knn~37 + 19 | 0.67 | 0.00 | 0.94 | 0.30 | 0.24 | 0.96 | 0.00 | 0.01 |
| svm~15 + 16 | 0.68 | 0.00 | 0.50 | 0.77 | 0.35 | 0.87 | 0.00 | 0.23 |
| nb~16 + 21 | 0.68 | 0.00 | 0.61 | 0.62 | 0.28 | 0.87 | 0.01 | 0.01 |
| rf~19 + 6 | 0.68 | 0.00 | 0.67 | 0.66 | 0.32 | 0.89 | 0.00 | 0.01 |
| nb~41 + 19 | 0.68 | 0.00 | 0.69 | 0.59 | 0.29 | 0.89 | 0.00 | 0.05 |
| svm~7 + 22 | 0.68 | 0.00 | 0.67 | 0.59 | 0.28 | 0.88 | 0.00 | 0.28 |
| nb~31 + 32 | 0.68 | 0.00 | 0.39 | 0.75 | 0.27 | 0.84 | 0.05 | 0.28 |
| rf~7 + 22 | 0.68 | 0.00 | 0.75 | 0.49 | 0.26 | 0.89 | 0.01 | 0.14 |
| rpart~1 + 24 | 0.67 | 0.00 | 0.58 | 0.77 | 0.38 | 0.88 | 0.00 | 0.00 |
| rf~16 + 24 | 0.68 | 0.00 | 0.64 | 0.59 | 0.27 | 0.87 | 0.01 | 0.02 |
| svm~16 + 13 | 0.68 | 0.00 | 0.53 | 0.67 | 0.28 | 0.85 | 0.03 | 0.33 |
| rf~18 + 22 | 0.68 | 0.00 | 0.69 | 0.60 | 0.29 | 0.89 | 0.00 | 0.22 |
| rf~31 + 22 | 0.68 | 0.00 | 0.75 | 0.56 | 0.29 | 0.90 | 0.00 | 0.10 |
| knn~19 + 21 | 0.67 | 0.00 | 0.78 | 0.57 | 0.30 | 0.91 | 0.00 | 0.00 | auc.pvalue: Wilcoxon Test P-value.
MFD: Median Fold Difference.
KM: Kaplan Meier curves.
MvaHRPval: Multivariable Analysis Hazard Ratio P-value.

TABLE 52 pairwise biomarkers from the 43 biomarker panel with significance for Wilcoxon P-value (auc.pvalue <= 0.05) and other metrics for the psaDT endpoint.

| Classifier | auc | auc. pvalue | Sensitivity | Specificity | Pos.Pred. Value | Neg.Pred. Value | mvaPval |
|---|---|---|---|---|---|---|---|
| svm~4 + 12 | 0.71 | 0.00 | 0.15 | 0.56 | 0.16 | 0.54 | 0.00 |
| rpart~24 + 32 | 0.70 | 0.00 | 0.07 | 0.65 | 0.09 | 0.55 | 0.00 |
| rpart~15 + 14 | 0.69 | 0.00 | 0.09 | 0.63 | 0.12 | 0.55 | 0.03 |
| svm~12 + 24 | 0.70 | 0.00 | 0.04 | 0.71 | 0.08 | 0.57 | 0.01 |
| knn~12 + 26 | 0.31 | 0.00 | 0.02 | 0.73 | 0.04 | 0.57 | 0.00 |
| svm~15 + 24 | 0.69 | 0.00 | 0.00 | 0.83 | 0.00 | 0.60 | 0.01 |
| nb~12 + 19 | 0.69 | 0.00 | 0.28 | 0.50 | 0.24 | 0.55 | 0.00 |
| rf~4 + 12 | 0.69 | 0.00 | 0.24 | 0.41 | 0.19 | 0.49 | 0.01 |
| knn~12 + 18 | 0.68 | 0.00 | 0.33 | 0.45 | 0.25 | 0.54 | 0.00 |
| svm~12 + 26 | 0.69 | 0.00 | 0.11 | 0.70 | 0.17 | 0.58 | 0.01 |
| nb~15 + 24 | 0.69 | 0.00 | 0.15 | 0.59 | 0.17 | 0.55 | 0.00 |
| nb~16 + 19 | 0.69 | 0.00 | 0.20 | 0.52 | 0.19 | 0.54 | 0.01 |
| nb~12 + 24 | 0.68 | 0.00 | 0.04 | 0.68 | 0.07 | 0.56 | 0.00 |
| rpart~12 + 24 | 0.68 | 0.00 | 0.09 | 0.65 | 0.12 | 0.56 | 0.00 |
| rf~12 + 22 | 0.68 | 0.00 | 0.22 | 0.44 | 0.18 | 0.50 | 0.00 |
| nb~12 + 6 | 0.68 | 0.00 | 0.37 | 0.44 | 0.27 | 0.55 | 0.00 |
| nb~12 + 26 | 0.68 | 0.00 | 0.15 | 0.60 | 0.18 | 0.56 | 0.00 |
| rf~12 + 26 | 0.68 | 0.00 | 0.20 | 0.65 | 0.24 | 0.59 | 0.00 |
| nb~12 + 18 | 0.68 | 0.00 | 0.15 | 0.57 | 0.17 | 0.55 | 0.00 |
| svm~16 + 24 | 0.68 | 0.00 | 0.07 | 0.71 | 0.11 | 0.57 | 0.01 |
| nb~37 + 19 | 0.68 | 0.00 | 0.33 | 0.49 | 0.26 | 0.56 | 0.08 |
| knn~12 + 22 | 0.68 | 0.00 | 0.28 | 0.45 | 0.22 | 0.53 | 0.01 |
| svm~15 + 12 | 0.68 | 0.00 | 0.04 | 0.70 | 0.07 | 0.56 | 0.01 |
| svm~16 + 19 | 0.68 | 0.00 | 0.35 | 0.48 | 0.27 | 0.57 | 0.02 |
| rpart~12 + 6 | 0.67 | 0.00 | 0.37 | 0.43 | 0.27 | 0.55 | 0.03 |
| rpart~1 + 24 | 0.67 | 0.00 | 0.17 | 0.57 | 0.19 | 0.55 | 0.01 |
| rpart~4 + 16 | 0.67 | 0.00 | 0.35 | 0.48 | 0.27 | 0.57 | 0.03 |
| knn~4 + 12 | 0.67 | 0.00 | 0.07 | 0.62 | 0.09 | 0.54 | 0.01 |
| nb~15 + 12 | 0.67 | 0.00 | 0.20 | 0.59 | 0.21 | 0.56 | 0.00 |
| svm~16 + 21 | 0.67 | 0.00 | 0.20 | 0.56 | 0.20 | 0.55 | 0.01 |
| rf~42 + 19 | 0.67 | 0.00 | 0.41 | 0.34 | 0.26 | 0.51 | 0.16 |
| rpart~15 + 24 | 0.66 | 0.00 | 0.46 | 0.34 | 0.28 | 0.53 | 0.04 |
| rpart~1 + 6 | 0.67 | 0.00 | 0.35 | 0.46 | 0.27 | 0.56 | 0.14 |
| svm~24 + 10 | 0.67 | 0.00 | 0.09 | 0.71 | 0.14 | 0.58 | 0.01 |
| knn~24 + 13 | 0.66 | 0.00 | 0.37 | 0.30 | 0.23 | 0.46 | 0.11 |
| rf~12 + 31 | 0.67 | 0.00 | 0.33 | 0.54 | 0.28 | 0.59 | 0.03 |

TABLE 52-continued pairwise biomarkers from the 43 biomarker panel with significance for
Wilcoxon P-value (auc.pvalue <= 0.05) and other metrics for the
psaDT endpoint.

| Classifier | auc | auc. pvalue | Sensitivity | Specificity | Pos.Pred. Value | Neg.Pred. Value | mvaPval |
|---|---|---|---|---|---|---|---|
| svm~24 + 8 | 0.66 | 0.00 | 0.13 | 0.72 | 0.21 | 0.60 | 0.30 |
| svm~12 + 28 | 0.66 | 0.00 | 0.30 | 0.56 | 0.28 | 0.59 | 0.08 |
| svm~12 + 18 | 0.66 | 0.00 | 0.17 | 0.54 | 0.17 | 0.54 | 0.01 |
| svm~12 + 37 | 0.66 | 0.00 | 0.33 | 0.49 | 0.26 | 0.56 | 0.14 |
| svm~15 + 38 | 0.66 | 0.00 | 0.15 | 0.61 | 0.18 | 0.56 | 0.01 |
| rpart~4 + 32 | 0.66 | 0.00 | 0.24 | 0.50 | 0.21 | 0.54 | 0.05 |
| rf~4 + 24 | 0.66 | 0.00 | 0.28 | 0.45 | 0.22 | 0.53 | 0.03 |
| rf~12 + 18 | 0.66 | 0.00 | 0.30 | 0.51 | 0.26 | 0.57 | 0.01 |
| nb~4 + 12 | 0.66 | 0.00 | 0.15 | 0.57 | 0.17 | 0.55 | 0.01 |
| nb~16 + 24 | 0.66 | 0.00 | 0.13 | 0.65 | 0.17 | 0.57 | 0.00 |
| nb~15 + 28 | 0.66 | 0.00 | 0.26 | 0.55 | 0.24 | 0.57 | 0.08 |
| nb~24 + 28 | 0.66 | 0.00 | 0.26 | 0.56 | 0.25 | 0.58 | 0.08 |
| nb~12 + 22 | 0.66 | 0.00 | 0.30 | 0.51 | 0.26 | 0.57 | 0.01 |
| svm~1 + 12 | 0.66 | 0.00 | 0.26 | 0.55 | 0.24 | 0.57 | 0.01 |
| svm~15 + 10 | 0.66 | 0.00 | 0.17 | 0.63 | 0.21 | 0.58 | 0.01 |
| nb~24 + 37 | 0.66 | 0.00 | 0.28 | 0.49 | 0.24 | 0.55 | 0.09 |
| nb~12 + 28 | 0.66 | 0.00 | 0.39 | 0.48 | 0.30 | 0.58 | 0.02 |
| knn~15 + 35 | 0.65 | 0.00 | 0.15 | 0.68 | 0.21 | 0.59 | 0.12 |
| nb~10 + 19 | 0.65 | 0.00 | 0.41 | 0.40 | 0.28 | 0.55 | 0.04 |
| svm~8 + 19 | 0.65 | 0.00 | 0.33 | 0.43 | 0.24 | 0.53 | 0.03 |
| svm~26 + 19 | 0.65 | 0.00 | 0.22 | 0.55 | 0.21 | 0.56 | 0.03 |
| knn~1 + 24 | 0.65 | 0.00 | 0.39 | 0.35 | 0.25 | 0.51 | 0.01 |
| rpart~15 + 12 | 0.65 | 0.00 | 0.15 | 0.60 | 0.18 | 0.56 | 0.02 |
| svm~13 + 26 | 0.65 | 0.00 | 0.13 | 0.67 | 0.18 | 0.58 | 0.05 |
| knn~15 + 17 | 0.65 | 0.00 | 0.22 | 0.59 | 0.23 | 0.57 | 0.02 |
| nb~15 + 14 | 0.65 | 0.00 | 0.09 | 0.71 | 0.14 | 0.58 | 0.04 |
| nb~12 + 20 | 0.65 | 0.00 | 0.48 | 0.37 | 0.30 | 0.56 | 0.01 |
| knn~4 + 32 | 0.65 | 0.00 | 0.35 | 0.44 | 0.26 | 0.55 | 0.40 |
| rf~12 + 20 | 0.65 | 0.00 | 0.46 | 0.41 | 0.30 | 0.58 | 0.16 |
| rf~12 + 19 | 0.65 | 0.00 | 0.33 | 0.50 | 0.27 | 0.57 | 0.01 |
| knn~17 + 24 | 0.64 | 0.00 | 0.30 | 0.48 | 0.25 | 0.55 | 0.01 |
| nb~16 + 6 | 0.65 | 0.00 | 0.30 | 0.50 | 0.25 | 0.56 | 0.02 |
| nb~15 + 16 | 0.65 | 0.00 | 0.17 | 0.65 | 0.22 | 0.58 | 0.01 |
| svm~13 + 19 | 0.65 | 0.00 | 0.48 | 0.30 | 0.28 | 0.51 | 0.31 |
| svm~1 + 19 | 0.65 | 0.00 | 0.26 | 0.49 | 0.22 | 0.54 | 0.01 |
| svm~24 + 13 | 0.65 | 0.01 | 0.07 | 0.65 | 0.09 | 0.55 | 0.01 |
| knn~16 + 28 | 0.65 | 0.01 | 0.39 | 0.40 | 0.27 | 0.54 | 0.06 |
| nb~13 + 19 | 0.65 | 0.01 | 0.52 | 0.32 | 0.30 | 0.54 | 0.11 |
| nb~24 + 6 | 0.65 | 0.01 | 0.13 | 0.67 | 0.18 | 0.58 | 0.03 |
| rf~4 + 43 | 0.65 | 0.01 | 0.35 | 0.44 | 0.26 | 0.55 | 0.26 |
| knn~18 + 13 | 0.64 | 0.01 | 0.57 | 0.21 | 0.29 | 0.46 | 0.38 |
| knn~24 + 43 | 0.64 | 0.01 | 0.35 | 0.45 | 0.26 | 0.55 | 0.04 |
| rpart~4 + 15 | 0.64 | 0.01 | 0.15 | 0.59 | 0.17 | 0.55 | 0.04 |
| rf~9 + 19 | 0.65 | 0.01 | 0.41 | 0.37 | 0.27 | 0.53 | 0.03 |
| nb~16 + 26 | 0.65 | 0.01 | 0.20 | 0.60 | 0.21 | 0.57 | 0.01 |
| knn~4 + 16 | 0.64 | 0.01 | 0.43 | 0.40 | 0.29 | 0.56 | 0.06 |
| knn~1 + 28 | 0.64 | 0.01 | 0.57 | 0.17 | 0.28 | 0.41 | 0.15 |
| knn~40 + 24 | 0.64 | 0.01 | 0.50 | 0.30 | 0.29 | 0.52 | 0.01 |
| rpart~28 + 34 | 0.64 | 0.01 | 0.33 | 0.55 | 0.29 | 0.59 | 0.38 |
| nb~16 + 18 | 0.65 | 0.01 | 0.28 | 0.50 | 0.24 | 0.55 | 0.01 |
| nb~15 + 10 | 0.65 | 0.01 | 0.52 | 0.35 | 0.31 | 0.57 | 0.01 |
| svm~42 + 16 | 0.65 | 0.01 | 0.17 | 0.61 | 0.20 | 0.57 | 0.01 |
| rf~4 + 32 | 0.65 | 0.01 | 0.26 | 0.50 | 0.23 | 0.55 | 0.05 |
| nb~35 + 19 | 0.65 | 0.01 | 0.24 | 0.54 | 0.22 | 0.56 | 0.15 |
| nb~28 + 6 | 0.65 | 0.01 | 0.35 | 0.50 | 0.28 | 0.58 | 0.23 |
| nb~4 + 24 | 0.65 | 0.01 | 0.13 | 0.67 | 0.18 | 0.58 | 0.04 |
| nb~16 + 21 | 0.65 | 0.01 | 0.26 | 0.52 | 0.24 | 0.56 | 0.03 |
| rpart~43 + 22 | 0.64 | 0.01 | 0.28 | 0.49 | 0.24 | 0.55 | 0.09 |
| svm~37 + 22 | 0.64 | 0.01 | 0.37 | 0.48 | 0.28 | 0.57 | 0.67 |
| svm~15 + 13 | 0.64 | 0.01 | 0.26 | 0.52 | 0.24 | 0.56 | 0.10 |
| rpart~24 + 8 | 0.64 | 0.01 | 0.20 | 0.73 | 0.29 | 0.62 | 0.21 |
| svm~42 + 24 | 0.64 | 0.01 | 0.04 | 0.73 | 0.08 | 0.58 | 0.09 |
| rpart~12 + 5 | 0.64 | 0.01 | 0.33 | 0.41 | 0.24 | 0.52 | 0.00 |
| knn~4 + 17 | 0.64 | 0.01 | 0.24 | 0.49 | 0.21 | 0.53 | 0.04 |
| svm~4 + 16 | 0.64 | 0.01 | 0.22 | 0.51 | 0.20 | 0.54 | 0.05 |
| rf~39 + 19 | 0.64 | 0.01 | 0.50 | 0.33 | 0.29 | 0.54 | 0.03 |
| nb~12 + 17 | 0.64 | 0.01 | 0.11 | 0.59 | 0.13 | 0.54 | 0.01 |
| svm~12 + 13 | 0.64 | 0.01 | 0.07 | 0.73 | 0.12 | 0.58 | 0.01 |
| nb~36 + 19 | 0.64 | 0.01 | 0.67 | 0.22 | 0.33 | 0.55 | 0.05 |
| rf~7 + 19 | 0.64 | 0.01 | 0.52 | 0.29 | 0.29 | 0.52 | 0.18 |
| nb~19 + 6 | 0.64 | 0.01 | 0.24 | 0.61 | 0.26 | 0.59 | 0.07 |
| knn~4 + 34 | 0.64 | 0.01 | 0.35 | 0.44 | 0.26 | 0.55 | 0.70 |
| nb~11 + 6 | 0.64 | 0.01 | 0.20 | 0.62 | 0.23 | 0.58 | 0.15 |

TABLE 52-continued pairwise biomarkers from the 43 biomarker panel with significance for
Wilcoxon P-value (auc.pvalue <= 0.05) and other metrics for the
psaDT endpoint.

| Classifier | auc | auc. pvalue | Sensitivity | Specificity | Pos.Pred. Value | Neg.Pred. Value | mvaPval |
|---|---|---|---|---|---|---|---|
| rpart~4 + 10 | 0.64 | 0.01 | 0.24 | 0.57 | 0.24 | 0.57 | 0.01 |
| knn~15 + 37 | 0.64 | 0.01 | 0.48 | 0.29 | 0.28 | 0.50 | 0.11 |
| nb~15 + 13 | 0.64 | 0.01 | 0.33 | 0.50 | 0.27 | 0.57 | 0.04 |
| svm~12 + 22 | 0.64 | 0.01 | 0.39 | 0.48 | 0.30 | 0.58 | 0.06 |
| rf~15 + 17 | 0.64 | 0.01 | 0.30 | 0.52 | 0.26 | 0.57 | 0.06 |
| nb~37 + 6 | 0.64 | 0.01 | 0.24 | 0.59 | 0.24 | 0.58 | 0.14 |
| rf~15 + 26 | 0.64 | 0.01 | 0.33 | 0.55 | 0.29 | 0.59 | 0.01 |
| knn~15 + 24 | 0.64 | 0.01 | 0.43 | 0.35 | 0.27 | 0.53 | 0.04 |
| nb~4 + 19 | 0.64 | 0.01 | 0.26 | 0.59 | 0.26 | 0.59 | 0.15 |
| rpart~12 + 26 | 0.39 | 0.01 | 0.09 | 0.68 | 0.13 | 0.57 | 0.01 |
| rpart~24 + 31 | 0.63 | 0.01 | 0.11 | 0.71 | 0.17 | 0.59 | 0.01 |
| svm~15 + 16 | 0.64 | 0.01 | 0.15 | 0.65 | 0.19 | 0.58 | 0.01 |
| nb~21 + 6 | 0.64 | 0.01 | 0.26 | 0.52 | 0.24 | 0.56 | 0.12 |
| rf~4 + 15 | 0.64 | 0.01 | 0.22 | 0.57 | 0.22 | 0.57 | 0.08 |
| nb~16 + 20 | 0.64 | 0.01 | 0.46 | 0.38 | 0.29 | 0.55 | 0.03 |
| rf~4 + 16 | 0.64 | 0.01 | 0.41 | 0.41 | 0.28 | 0.56 | 0.23 |
| knn~13 + 19 | 0.63 | 0.01 | 0.24 | 0.63 | 0.27 | 0.60 | 0.14 |
| knn~4 + 24 | 0.63 | 0.01 | 0.20 | 0.60 | 0.21 | 0.57 | 0.21 |
| knn~38 + 22 | 0.63 | 0.01 | 0.33 | 0.44 | 0.25 | 0.54 | 0.25 |
| knn~32 + 22 | 0.63 | 0.01 | 0.26 | 0.48 | 0.22 | 0.53 | 0.11 |
| nb~11 + 28 | 0.64 | 0.01 | 0.24 | 0.63 | 0.27 | 0.60 | 0.71 |
| nb~12 + 16 | 0.64 | 0.01 | 0.17 | 0.57 | 0.19 | 0.55 | 0.01 |
| rpart~24 + 34 | 0.63 | 0.01 | 0.07 | 0.79 | 0.15 | 0.60 | 0.05 |
| nb~13 + 6 | 0.64 | 0.01 | 0.43 | 0.44 | 0.30 | 0.58 | 0.12 |
| rf~19 + 21 | 0.63 | 0.01 | 0.33 | 0.37 | 0.22 | 0.49 | 0.01 |
| knn~15 + 8 | 0.63 | 0.01 | 0.48 | 0.32 | 0.28 | 0.52 | 0.19 |
| nb~15 + 37 | 0.63 | 0.01 | 0.20 | 0.61 | 0.22 | 0.57 | 0.06 |
| nb~12 + 37 | 0.63 | 0.01 | 0.37 | 0.46 | 0.28 | 0.57 | 0.08 |
| knn~16 + 19 | 0.63 | 0.01 | 0.41 | 0.40 | 0.28 | 0.55 | 0.01 |
| rf~39 + 22 | 0.63 | 0.01 | 0.35 | 0.50 | 0.28 | 0.58 | 0.08 |
| rf~15 + 35 | 0.63 | 0.01 | 0.26 | 0.55 | 0.24 | 0.57 | 0.12 |
| rf~4 + 42 | 0.63 | 0.01 | 0.37 | 0.49 | 0.29 | 0.58 | 0.23 |
| nb~4 + 28 | 0.63 | 0.01 | 0.22 | 0.60 | 0.23 | 0.58 | 0.39 |
| rpart~15 + 9 | 0.62 | 0.01 | 0.15 | 0.60 | 0.18 | 0.56 | 0.08 |
| knn~12 + 19 | 0.63 | 0.01 | 0.37 | 0.46 | 0.28 | 0.57 | 0.01 |
| rf~4 + 39 | 0.63 | 0.01 | 0.33 | 0.49 | 0.26 | 0.56 | 0.04 |
| rpart~17 + 13 | 0.39 | 0.01 | 0.13 | 0.68 | 0.19 | 0.58 | 0.05 |
| rpart~15 + 16 | 0.40 | 0.01 | 0.07 | 0.74 | 0.13 | 0.59 | 0.06 |
| rpart~12 + 17 | 0.62 | 0.01 | 0.24 | 0.50 | 0.21 | 0.54 | 0.02 |
| nb~16 + 17 | 0.63 | 0.01 | 0.17 | 0.65 | 0.22 | 0.58 | 0.01 |
| svm~37 + 6 | 0.63 | 0.01 | 0.37 | 0.45 | 0.27 | 0.56 | 0.37 |
| knn~12 + 31 | 0.63 | 0.01 | 0.63 | 0.30 | 0.34 | 0.60 | 0.03 |
| rpart~4 + 13 | 0.63 | 0.01 | 0.35 | 0.51 | 0.29 | 0.58 | 0.10 |
| rf~42 + 26 | 0.63 | 0.01 | 0.57 | 0.30 | 0.31 | 0.56 | 0.32 |
| rf~32 + 22 | 0.63 | 0.01 | 0.30 | 0.46 | 0.24 | 0.54 | 0.06 |
| rf~16 + 10 | 0.63 | 0.01 | 0.22 | 0.60 | 0.23 | 0.58 | 0.02 |
| nb~37 + 28 | 0.63 | 0.01 | 0.28 | 0.55 | 0.26 | 0.58 | 0.69 |
| nb~12 + 32 | 0.63 | 0.01 | 0.17 | 0.55 | 0.18 | 0.54 | 0.01 |
| rf~37 + 19 | 0.63 | 0.01 | 0.41 | 0.37 | 0.27 | 0.53 | 0.20 |
| rpart~16 + 41 | 0.63 | 0.01 | 0.24 | 0.55 | 0.23 | 0.56 | 0.01 |
| svm~35 + 19 | 0.63 | 0.01 | 0.30 | 0.54 | 0.27 | 0.58 | 0.28 |
| nb~4 + 17 | 0.63 | 0.01 | 0.22 | 0.62 | 0.24 | 0.59 | 0.11 |
| knn~12 + 6 | 0.63 | 0.01 | 0.28 | 0.44 | 0.22 | 0.52 | 0.03 |
| svm~10 + 19 | 0.63 | 0.01 | 0.28 | 0.51 | 0.25 | 0.56 | 0.00 |
| rf~24 + 28 | 0.63 | 0.01 | 0.35 | 0.50 | 0.28 | 0.58 | 0.04 |
| rf~24 + 13 | 0.63 | 0.01 | 0.37 | 0.48 | 0.28 | 0.57 | 0.14 |
| rpart~4 + 24 | 0.62 | 0.02 | 0.20 | 0.62 | 0.23 | 0.58 | 0.08 |
| knn~24 + 28 | 0.63 | 0.02 | 0.17 | 0.65 | 0.22 | 0.58 | 0.04 |
| rpart~15 + 8 | 0.63 | 0.02 | 0.20 | 0.59 | 0.21 | 0.56 | 0.42 |
| nb~25 + 6 | 0.63 | 0.02 | 0.33 | 0.52 | 0.28 | 0.58 | 0.09 |
| svm~12 + 10 | 0.63 | 0.02 | 0.20 | 0.61 | 0.22 | 0.57 | 0.01 |
| rpart~15 + 13 | 0.63 | 0.02 | 0.26 | 0.62 | 0.28 | 0.60 | 0.10 |
| svm~19 + 28 | 0.63 | 0.02 | 0.37 | 0.54 | 0.31 | 0.60 | 0.26 |
| svm~24 + 37 | 0.63 | 0.02 | 0.22 | 0.63 | 0.25 | 0.59 | 0.71 |
| rpart~16 + 6 | 0.62 | 0.02 | 0.26 | 0.52 | 0.24 | 0.56 | 0.06 |
| rpart~16 + 22 | 0.63 | 0.02 | 0.37 | 0.44 | 0.27 | 0.55 | 0.02 |
| svm~40 + 19 | 0.63 | 0.02 | 0.37 | 0.44 | 0.27 | 0.55 | 0.16 |
| svm~4 + 24 | 0.63 | 0.02 | 0.15 | 0.63 | 0.19 | 0.57 | 0.02 |
| rpart~11 + 22 | 0.38 | 0.02 | 0.22 | 0.57 | 0.22 | 0.57 | 0.49 |
| rf~12 + 6 | 0.63 | 0.02 | 0.33 | 0.39 | 0.23 | 0.51 | 0.01 |
| nb~4 + 16 | 0.63 | 0.02 | 0.17 | 0.63 | 0.21 | 0.58 | 0.06 |
| nb~16 + 28 | 0.63 | 0.02 | 0.39 | 0.48 | 0.30 | 0.58 | 0.11 |
| svm~11 + 28 | 0.63 | 0.02 | 0.24 | 0.59 | 0.24 | 0.58 | 0.85 |

TABLE 52-continued pairwise biomarkers from the 43 biomarker panel with significance for Wilcoxon P-value (auc.pvalue <= 0.05) and other metrics for the psaDT endpoint.

| Classifier | auc | auc. pvalue | Sensitivity | Specificity | Pos.Pred. Value | Neg.Pred. Value | mvaPval |
|---|---|---|---|---|---|---|---|
| knn~9 + 6 | 0.63 | 0.02 | 0.48 | 0.30 | 0.28 | 0.51 | 0.26 |
| svm~13 + 6 | 0.63 | 0.02 | 0.39 | 0.50 | 0.31 | 0.59 | 0.63 |
| svm~28 + 32 | 0.63 | 0.02 | 0.33 | 0.66 | 0.35 | 0.64 | 0.40 |
| svm~40 + 24 | 0.63 | 0.02 | 0.35 | 0.46 | 0.27 | 0.56 | 0.08 |
| rpart~14 + 24 | 0.62 | 0.02 | 0.07 | 0.74 | 0.13 | 0.59 | 0.05 |
| rpart~16 + 26 | 0.63 | 0.02 | 0.22 | 0.62 | 0.24 | 0.59 | 0.05 |
| knn~16 + 29 | 0.38 | 0.02 | 0.26 | 0.56 | 0.25 | 0.58 | 0.02 |
| nb~15 + 6 | 0.63 | 0.02 | 0.15 | 0.66 | 0.20 | 0.58 | 0.03 |
| rf~29 + 19 | 0.63 | 0.02 | 0.37 | 0.41 | 0.26 | 0.54 | 0.00 |
| rf~4 + 21 | 0.63 | 0.02 | 0.33 | 0.54 | 0.28 | 0.59 | 0.51 |
| nb~4 + 15 | 0.63 | 0.02 | 0.11 | 0.61 | 0.14 | 0.55 | 0.07 |
| rf~24 + 19 | 0.63 | 0.02 | 0.26 | 0.56 | 0.25 | 0.58 | 0.02 |
| nb~9 + 19 | 0.63 | 0.02 | 0.35 | 0.48 | 0.27 | 0.57 | 0.70 |
| svm~21 + 6 | 0.63 | 0.02 | 0.33 | 0.49 | 0.26 | 0.56 | 0.16 |
| rf~15 + 10 | 0.63 | 0.02 | 0.30 | 0.52 | 0.26 | 0.57 | 0.01 |
| knn~17 + 37 | 0.62 | 0.02 | 0.65 | 0.26 | 0.33 | 0.57 | 0.28 |
| rpart~17 + 18 | 0.39 | 0.02 | 0.22 | 0.56 | 0.22 | 0.56 | 0.14 |
| nb~1 + 19 | 0.63 | 0.02 | 0.57 | 0.30 | 0.31 | 0.56 | 0.04 |
| svm~1 + 16 | 0.63 | 0.02 | 0.09 | 0.74 | 0.16 | 0.59 | 0.03 |
| rpart~42 + 15 | 0.62 | 0.02 | 0.22 | 0.56 | 0.22 | 0.56 | 0.33 |
| rpart~4 + 12 | 0.62 | 0.02 | 0.35 | 0.44 | 0.26 | 0.55 | 0.00 |
| rf~15 + 19 | 0.63 | 0.02 | 0.30 | 0.56 | 0.28 | 0.59 | 0.00 |
| rf~15 + 24 | 0.63 | 0.02 | 0.30 | 0.50 | 0.25 | 0.56 | 0.06 |
| nb~26 + 6 | 0.63 | 0.02 | 0.26 | 0.59 | 0.26 | 0.59 | 0.08 |
| svm~16 + 18 | 0.62 | 0.02 | 0.22 | 0.55 | 0.21 | 0.56 | 0.03 |
| nb~16 + 22 | 0.62 | 0.02 | 0.35 | 0.52 | 0.29 | 0.59 | 0.06 |
| nb~17 + 6 | 0.62 | 0.02 | 0.28 | 0.63 | 0.30 | 0.61 | 0.10 |
| nb~24 + 13 | 0.62 | 0.02 | 0.17 | 0.66 | 0.22 | 0.59 | 0.05 |
| knn~12 + 10 | 0.62 | 0.02 | 0.50 | 0.29 | 0.28 | 0.51 | 0.02 |
| knn~9 + 19 | 0.62 | 0.02 | 0.48 | 0.35 | 0.29 | 0.55 | 0.79 |
| svm~16 + 26 | 0.62 | 0.02 | 0.20 | 0.60 | 0.21 | 0.57 | 0.02 |
| rf~4 + 8 | 0.62 | 0.02 | 0.59 | 0.29 | 0.32 | 0.56 | 0.14 |
| rf~10 + 22 | 0.62 | 0.02 | 0.37 | 0.43 | 0.27 | 0.55 | 0.03 |
| nb~37 + 22 | 0.62 | 0.02 | 0.37 | 0.48 | 0.28 | 0.57 | 0.45 |
| svm~13 + 28 | 0.62 | 0.02 | 0.35 | 0.46 | 0.27 | 0.56 | 0.42 |
| rf~1 + 19 | 0.62 | 0.02 | 0.41 | 0.46 | 0.30 | 0.58 | 0.18 |
| nb~15 + 35 | 0.62 | 0.02 | 0.30 | 0.56 | 0.28 | 0.59 | 0.07 |
| svm~4 + 25 | 0.62 | 0.02 | 0.37 | 0.45 | 0.27 | 0.56 | 0.28 |
| nb~12 + 13 | 0.62 | 0.02 | 0.26 | 0.59 | 0.26 | 0.59 | 0.04 |
| nb~24 + 10 | 0.62 | 0.02 | 0.39 | 0.43 | 0.28 | 0.56 | 0.02 |
| rf~10 + 19 | 0.62 | 0.02 | 0.37 | 0.44 | 0.27 | 0.55 | 0.02 |
| rpart~16 + 10 | 0.61 | 0.02 | 0.24 | 0.55 | 0.23 | 0.56 | 0.00 |
| svm~12 + 5 | 0.62 | 0.02 | 0.39 | 0.41 | 0.27 | 0.55 | 0.06 |
| svm~9 + 19 | 0.62 | 0.02 | 0.35 | 0.40 | 0.25 | 0.52 | 0.24 |
| svm~32 + 22 | 0.62 | 0.02 | 0.26 | 0.57 | 0.26 | 0.58 | 0.03 |
| knn~15 + 28 | 0.62 | 0.02 | 0.17 | 0.65 | 0.22 | 0.58 | 0.19 |
| nb~16 + 32 | 0.62 | 0.02 | 0.26 | 0.55 | 0.24 | 0.57 | 0.03 |
| rpart~42 + 24 | 0.62 | 0.02 | 0.17 | 0.68 | 0.24 | 0.60 | 0.07 |
| nb~14 + 6 | 0.62 | 0.02 | 0.24 | 0.61 | 0.26 | 0.59 | 0.16 |
| nb~12 + 38 | 0.62 | 0.02 | 0.20 | 0.59 | 0.21 | 0.56 | 0.00 |
| rf~13 + 19 | 0.62 | 0.02 | 0.57 | 0.33 | 0.32 | 0.57 | 0.13 |
| nb~16 + 37 | 0 62 | 0.02 | 0.33 | 0.44 | 0.25 | 0.54 | 0.21 |
| svm~4 + 42 | 0.62 | 0.02 | 0.39 | 0.44 | 0.28 | 0.56 | 0.22 |
| rpart~37 + 22 | 0.61 | 0.03 | 0.33 | 0.48 | 0.26 | 0.56 | 0.72 |
| knn~18 + 10 | 0.38 | 0.03 | 0.54 | 0.23 | 0.28 | 0.48 | 0.13 |
| rf~4 + 10 | 0.62 | 0.03 | 0.17 | 0.66 | 0.22 | 0.59 | 0.34 |
| svm~4 + 28 | 0.62 | 0.03 | 0.30 | 0.59 | 0.29 | 0.60 | 0.58 |
| nb~18 + 6 | 0.62 | 0.03 | 0.33 | 0.56 | 0.29 | 0.60 | 0.13 |
| nb~12 + 41 | 0.62 | 0.03 | 0.15 | 0.63 | 0.19 | 0.57 | 0.06 |
| nb~12 + 10 | 0.62 | 0.03 | 0.35 | 0.56 | 0.31 | 0.61 | 0.02 |
| svm~11 + 22 | 0.62 | 0.03 | 0.33 | 0.54 | 0.28 | 0.59 | 0.71 |
| svm~8 + 28 | 0.62 | 0.03 | 0.30 | 0.46 | 0.24 | 0.54 | 0.10 |
| nb~10 + 6 | 0.62 | 0.03 | 0.17 | 0.63 | 0.21 | 0.58 | 0.05 |
| rf~31 + 19 | 0.62 | 0.03 | 0.41 | 0.39 | 0.28 | 0.54 | 0.05 |
| rf~12 + 2 | 0.62 | 0.03 | 0.33 | 0.49 | 0.26 | 0.56 | 0.04 |
| svm~16 + 38 | 0.62 | 0.03 | 0.22 | 0.56 | 0.22 | 0.56 | 0.01 |
| nb~39 + 6 | 0.62 | 0.03 | 0.24 | 0.59 | 0.24 | 0.58 | 0.06 |
| rf~16 + 19 | 0.62 | 0.03 | 0.41 | 0.44 | 0.29 | 0.57 | 0.01 |
| svm~12 + 6 | 0.62 | 0.03 | 0.30 | 0.49 | 0.25 | 0.56 | 0.01 |
| svm~16 + 34 | 0.62 | 0.03 | 0.28 | 0.60 | 0.28 | 0.60 | 0.05 |
| rf~15 + 8 | 0.62 | 0.03 | 0.28 | 0.51 | 0.25 | 0.56 | 0.15 |
| nb~10 + 28 | 0.62 | 0.03 | 0.22 | 0.65 | 0.26 | 0.60 | 0.31 |
| nb~10 + 20 | 0.62 | 0.03 | 0.37 | 0.45 | 0.27 | 0.56 | 0.10 |

TABLE 52-continued pairwise biomarkers from the 43 biomarker panel with significance for Wilcoxon P-value (auc.pvalue <= 0.05) and other metrics for the psaDT endpoint.

| Classifier | auc | auc. pvalue | Sensitivity | Specificity | Pos.Pred. Value | Neg.Pred. Value | mvaPval |
|---|---|---|---|---|---|---|---|
| rpart~4 + 18 | 0.61 | 0.03 | 0.35 | 0.51 | 0.29 | 0.58 | 0.89 |
| knn~35 + 19 | 0.39 | 0.03 | 0.57 | 0.24 | 0.30 | 0.50 | 0.14 |
| rpart~18 + 32 | 0.62 | 0.03 | 0.39 | 0.45 | 0.29 | 0.57 | 0.09 |
| svm~7 + 28 | 0.62 | 0.03 | 0.39 | 0.52 | 0.32 | 0.61 | 0.76 |
| knn~1 + 22 | 0.39 | 0.03 | 0.37 | 0.51 | 0.30 | 0.59 | 0.02 |
| rpart~4 + 41 | 0.61 | 0.03 | 0.22 | 0.61 | 0.24 | 0.58 | 0.08 |
| svm~43 + 22 | 0.62 | 0.03 | 0.22 | 0.62 | 0.24 | 0.59 | 0.25 |
| rpart~1 + 28 | 0.62 | 0.03 | 0.33 | 0.48 | 0.26 | 0.56 | 0.60 |
| rpart~12 + 31 | 0.62 | 0.03 | 0.28 | 0.59 | 0.28 | 0.59 | 0.05 |
| rpart~10 + 22 | 0.61 | 0.03 | 0.33 | 0.50 | 0.27 | 0.57 | 0.01 |
| nb~40 + 24 | 0.62 | 0.03 | 0.28 | 0.54 | 0.25 | 0.57 | 0.07 |
| svm~4 + 10 | 0.62 | 0.03 | 0.15 | 0.61 | 0.18 | 0.56 | 0.05 |
| svm~13 + 32 | 0.62 | 0.03 | 0.24 | 0.71 | 0.31 | 0.62 | 0.52 |
| rpart~4 + 1 | 0.39 | 0.03 | 0.52 | 0.35 | 0.31 | 0.57 | 0.35 |
| rf~16 + 24 | 0.62 | 0.03 | 0.30 | 0.55 | 0.27 | 0.58 | 0.16 |
| rf~4 + 19 | 0.62 | 0.03 | 0.37 | 0.45 | 0.27 | 0.56 | 0.05 |
| rpart~24 + 10 | 0.40 | 0.03 | 0.20 | 0.67 | 0.25 | 0.60 | 0.00 |
| svm~19 + 6 | 0.62 | 0.03 | 0.37 | 0.52 | 0.30 | 0.60 | 0.14 |
| nb~15 + 36 | 0.62 | 0.03 | 0.26 | 0.55 | 0.24 | 0.57 | 0.01 |
| knn~43 + 22 | 0.61 | 0.03 | 0.43 | 0.24 | 0.24 | 0.43 | 0.13 |
| knn~4 + 7 | 0.61 | 0.03 | 0.22 | 0.67 | 0.27 | 0.60 | 0.22 |
| nb~20 + 6 | 0.62 | 0.03 | 0.28 | 0.55 | 0.26 | 0.58 | 0.19 |
| rpart~24 + 38 | 0.61 | 0.03 | 0.24 | 0.62 | 0.26 | 0.59 | 0.15 |
| svm~24 + 25 | 0.61 | 0.03 | 0.20 | 0.66 | 0.24 | 0.59 | 0.07 |
| knn~11 + 28 | 0.61 | 0.03 | 0.59 | 0.23 | 0.30 | 0.50 | 0.78 |
| rf~24 + 43 | 0.61 | 0.03 | 0.17 | 0.67 | 0.23 | 0.59 | 0.05 |
| rf~9 + 22 | 0.61 | 0.03 | 0.28 | 0.51 | 0.25 | 0.56 | 0.10 |
| knn~26 + 2 | 0.61 | 0.03 | 0.59 | 0.21 | 0.29 | 0.47 | 0.22 |
| knn~24 + 20 | 0.39 | 0.03 | 0.17 | 0.78 | 0.31 | 0.63 | 0.07 |
| rf~24 + 10 | 0.61 | 0.03 | 0.30 | 0.55 | 0.27 | 0.58 | 0.02 |
| svm~29 + 22 | 0.61 | 0.03 | 0.46 | 0.46 | 0.32 | 0.60 | 0.24 |
| nb~43 + 6 | 0.61 | 0.03 | 0.20 | 0.62 | 0.23 | 0.58 | 0.11 |
| rpart~1 + 15 | 0.61 | 0.03 | 0.22 | 0.63 | 0.25 | 0.59 | 0.05 |
| rpart~38 + 22 | 0.61 | 0.03 | 0.39 | 0.40 | 0.27 | 0.54 | 0.87 |
| rpart~18 + 13 | 0.61 | 0.03 | 0.43 | 0.44 | 0.30 | 0.58 | 0.95 |
| nb~16 + 38 | 0.61 | 0.03 | 0.28 | 0.61 | 0.29 | 0.60 | 0.01 |
| nb~18 + 13 | 0.61 | 0.03 | 0.37 | 0.48 | 0.28 | 0.57 | 0.26 |
| nb~24 + 31 | 0.61 | 0.03 | 0.26 | 0.56 | 0.25 | 0.58 | 0.01 |
| svm~26 + 37 | 0.61 | 0.03 | 0.15 | 0.68 | 0.21 | 0.59 | 0.95 |
| knn~4 + 42 | 0.39 | 0.03 | 0.70 | 0.21 | 0.33 | 0.55 | 0.08 |
| svm~16 + 8 | 0.61 | 0.03 | 0.26 | 0.55 | 0.24 | 0.57 | 0.02 |
| rf~18 + 13 | 0.61 | 0.03 | 0.48 | 0.43 | 0.32 | 0.59 | 0.95 |
| nb~13 + 28 | 0.61 | 0.04 | 0.33 | 0.54 | 0.28 | 0.59 | 0.61 |
| rf~19 + 28 | 0.61 | 0.04 | 0.41 | 0.39 | 0.28 | 0.54 | 0.03 |
| svm~36 + 19 | 0.61 | 0.04 | 0.30 | 0.50 | 0.25 | 0.56 | 0.02 |
| svm~12 + 9 | 0.61 | 0.04 | 0.26 | 0.60 | 0.27 | 0.59 | 0.14 |
| svm~12 + 27 | 0.61 | 0.04 | 0.30 | 0.52 | 0.26 | 0.57 | 0.01 |
| rpart~16 + 3 | 0.41 | 0.04 | 0.11 | 0.82 | 0.25 | 0.62 | 0.67 |
| rf~10 + 28 | 0.61 | 0.04 | 0.50 | 0.44 | 0.33 | 0.61 | 0.41 |
| nb~35 + 6 | 0.61 | 0.04 | 0.24 | 0.56 | 0.23 | 0.57 | 0.12 |
| knn~4 + 10 | 0.39 | 0.04 | 0.22 | 0.60 | 0.23 | 0.58 | 0.14 |
| svm~4 + 11 | 0.61 | 0.04 | 0.13 | 0.63 | 0.17 | 0.57 | 0.20 |
| nb~16 + 11 | 0.61 | 0.04 | 0.35 | 0.57 | 0.31 | 0.61 | 0.17 |
| knn~37 + 22 | 0.61 | 0.04 | 0.54 | 0.27 | 0.29 | 0.51 | 0.26 |
| rpart~16 + 25 | 0.60 | 0.04 | 0.41 | 0.45 | 0.30 | 0.58 | 0.26 |
| nb~15 + 31 | 0.61 | 0.04 | 0.26 | 0.60 | 0.27 | 0.59 | 0.02 |
| knn~12 + 28 | 0.61 | 0.04 | 0.15 | 0.63 | 0.19 | 0.57 | 0.19 |
| knn~4 + 43 | 0.39 | 0.04 | 0.33 | 0.52 | 0.28 | 0.58 | 0.41 |
| svm~16 + 22 | 0.61 | 0.04 | 0.37 | 0.50 | 0.29 | 0.59 | 0.15 |
| svm~16 + 28 | 0.61 | 0.04 | 0.33 | 0.51 | 0.27 | 0.58 | 0.19 |
| nb~4 + 10 | 0.61 | 0.04 | 0.11 | 0.71 | 0.17 | 0.59 | 0.13 |
| knn~16 + 18 | 0.61 | 0.04 | 0.28 | 0.45 | 0.22 | 0.53 | 0.14 |
| knn~8 + 19 | 0.61 | 0.04 | 0.37 | 0.44 | 0.27 | 0.55 | 0.23 |
| nb~18 + 37 | 0.61 | 0.04 | 0.35 | 0.49 | 0.28 | 0.57 | 0.41 |
| svm~24 + 2 | 0.61 | 0.04 | 0.22 | 0.60 | 0.23 | 0.58 | 0.74 |
| knn~18 + 20 | 0.61 | 0.04 | 0.17 | 0.70 | 0.24 | 0.60 | 0.24 |
| knn~26 + 20 | 0.61 | 0.04 | 0.48 | 0.43 | 0.32 | 0.59 | 0.10 |
| nb~16 + 13 | 0.61 | 0.04 | 0.26 | 0.54 | 0.24 | 0.56 | 0.14 |
| nb~14 + 28 | 0.61 | 0.04 | 0.28 | 0.61 | 0.29 | 0.60 | 0.66 |
| svm~42 + 15 | 0.61 | 0.04 | 0.26 | 0.61 | 0.27 | 0.60 | 0.13 |
| svm~4 + 21 | 0.61 | 0.04 | 0.22 | 0.63 | 0.25 | 0.59 | 0.64 |
| rpart~24 + 33 | 0.60 | 0.04 | 0.17 | 0.67 | 0.23 | 0.59 | 0.23 |
| rpart~13 + 22 | 0.61 | 0.04 | 0.48 | 0.34 | 0.29 | 0.54 | 0.50 |

TABLE 52-continued pairwise biomarkers from the 43 biomarker panel with significance for Wilcoxon P-value (auc.pvalue <= 0.05) and other metrics for the psaDT endpoint.

| Classifier | auc | auc. pvalue | Sensitivity | Specificity | Pos.Pred. Value | Neg.Pred. Value | mvaPval |
|---|---|---|---|---|---|---|---|
| rf~1 + 28 | 0.61 | 0.04 | 0.37 | 0.39 | 0.25 | 0.52 | 0.21 |
| knn~24 + 10 | 0.61 | 0.04 | 0.37 | 0.41 | 0.26 | 0.54 | 0.01 |
| rf~40 + 24 | 0.61 | 0.04 | 0.33 | 0.54 | 0.28 | 0.59 | 0.03 |
| knn~4 + 20 | 0.61 | 0.04 | 0.46 | 0.38 | 0.29 | 0.55 | 0.20 |
| rpart~20 + 28 | 0.60 | 0.04 | 0.54 | 0.33 | 0.31 | 0.56 | 0.30 |
| rf~15 + 16 | 0.61 | 0.04 | 0.17 | 0.61 | 0.20 | 0.57 | 0.01 |
| svm~31 + 28 | 0.61 | 0.04 | 0.43 | 0.49 | 0.32 | 0.61 | 0.26 |
| nb~10 + 22 | 0.61 | 0.04 | 0.33 | 0.56 | 0.29 | 0.60 | 0.19 |
| knn~4 + 8 | 0.61 | 0.04 | 0.13 | 0.71 | 0.20 | 0.59 | 0.11 |
| svm~4 + 19 | 0.61 | 0.04 | 0.35 | 0.43 | 0.25 | 0.54 | 0.19 |
| knn~29 + 19 | 0.61 | 0.04 | 0.17 | 0.65 | 0.22 | 0.58 | 0.03 |
| nb~38 + 28 | 0.61 | 0.04 | 0.30 | 0.49 | 0.25 | 0.56 | 0.04 |
| svm~16 + 31 | 0.61 | 0.04 | 0.20 | 0.61 | 0.22 | 0.57 | 0.03 |
| nb~16 + 29 | 0.61 | 0.04 | 0.26 | 0.63 | 0.29 | 0.60 | 0.09 |
| knn~26 + 19 | 0.61 | 0.05 | 0.41 | 0.43 | 0.29 | 0.56 | 0.03 |
| nb~22 + 6 | 0.61 | 0.05 | 0.35 | 0.52 | 0.29 | 0.59 | 0.19 |
| svm~2 + 28 | 0.61 | 0.05 | 0.35 | 0.43 | 0.25 | 0.54 | 0.65 |
| svm~37 + 28 | 0.61 | 0.05 | 0.37 | 0.46 | 0.28 | 0.57 | 0.99 |
| rf~19 + 34 | 0.61 | 0.05 | 0.33 | 0.44 | 0.25 | 0.54 | 0.02 |
| svm~4 + 14 | 0.61 | 0.05 | 0.15 | 0.60 | 0.18 | 0.56 | 0.27 |
| svm~28 + 21 | 0.61 | 0.05 | 0.33 | 0.56 | 0.29 | 0.60 | 0.67 |
| rpart~29 + 6 | 0.60 | 0.05 | 0.33 | 0.54 | 0.28 | 0.59 | 0.09 |
| svm~16 + 13 | 0.61 | 0.05 | 0.24 | 0.57 | 0.24 | 0.57 | 0.09 |
| rpart~15 + 6 | 0.60 | 0.05 | 0.33 | 0.52 | 0.28 | 0.58 | 0.31 |
| rpart~31 + 6 | 0.60 | 0.05 | 0.39 | 0.50 | 0.31 | 0.59 | 0.40 |
| nb~4 + 6 | 0.61 | 0.05 | 0.24 | 0.57 | 0.24 | 0.57 | 0.33 |
| svm~15 + 22 | 0.61 | 0.05 | 0.22 | 0.60 | 0.23 | 0.58 | 0.16 |
| svm~15 + 37 | 0.61 | 0.05 | 0.17 | 0.66 | 0.22 | 0.59 | 0.21 |
| svm~16 + 32 | 0.61 | 0.05 | 0.13 | 0.67 | 0.18 | 0.58 | 0.02 |
| knn~4 + 15 | 0.40 | 0.05 | 0.24 | 0.56 | 0.23 | 0.57 | 0.06 |
| knn~12 + 2 | 0.60 | 0.05 | 0.39 | 0.49 | 0.30 | 0.59 | 0.24 |
| nb~15 + 34 | 0.61 | 0.05 | 0.20 | 0.68 | 0.26 | 0.60 | 0.07 |
| svm~8 + 32 | 0.61 | 0.05 | 0.22 | 0.66 | 0.26 | 0.60 | 0.03 |
| nb~1 + 6 | 0.61 | 0.05 | 0.26 | 0.60 | 0.27 | 0.59 | 0.09 |
| nb~12 + 5 | 0.61 | 0.05 | 0.59 | 0.28 | 0.31 | 0.55 | 0.04 |
| svm~35 + 6 | 0.61 | 0.05 | 0.24 | 0.59 | 0.24 | 0.58 | 0.48 |
| nb~16 + 31 | 0.61 | 0.05 | 0.24 | 0.59 | 0.24 | 0.58 | 0.05 |
| svm~4 + 37 | 0.61 | 0.05 | 0.30 | 0.50 | 0.25 | 0.56 | 0.51 |
| nb~12 + 35 | 0.61 | 0.05 | 0.20 | 0.61 | 0.22 | 0.57 | 0.08 |
| rpart~10 + 32 | 0.60 | 0.05 | 0.24 | 0.68 | 0.30 | 0.62 | 0.02 |
| svm~15 + 35 | 0.60 | 0.05 | 0.20 | 0.67 | 0.25 | 0.60 | 0.62 |
| svm~14 + 6 | 0.60 | 0.05 | 0.37 | 0.59 | 0.33 | 0.62 | 0.25 |
| rf~24 + 22 | 0.60 | 0.05 | 0.30 | 0.48 | 0.25 | 0.55 | 0.14 | auc.pvalue: Wilcoxon Test P-value.
MFD: Median Fold Difference.
KM: Kaplan Meier curves.
mvaHRPval: Multivariable Analysis Hazard Ratio P-value.

Example 13: A 2,040 Biomarker Library for Prostate Cancer Progression

In order to define, from the entire set of 1.4 million features, a comprehensive library of biomarkers that presents prognostic ability, the Discovery Set (Training and Testing) presented in Example 1 was processed as follows. First, all features with a probe count lower than 4 or with cross-hybridizing probes as defined by affymetrix (www.affymetrix.com) were removed. Second, a background filter was applied in order to ensure signal in the expression capture for each feature. To achieve this, features that had a median expression value in the group of mets patients and in the group of non-mets patients (separately) lower than 1.2 times the background signal (captured by the control antigenomic probes defined by affymetrix (www.affymetrix.com)) were removed. Third, the statistical significance of the differential expression observed between the mets and non-mets groups was assessed using the Kolmogorov-Smirnov test for each feature. Those features with a p-value greater than 0.05 were removed. Last, a Random forest variable importance was calculated by building a random forest with 450,000 trees. Features with Mean Decrease Gini (or MDG)<=0 were discarded and features with MDG>6.5e-3 and Mean Decrease in Accuracy (or MDA)>0 were selected, reducing the feature set to 2,040 features. MDA is defined as the average difference in accuracy of the true variable vs the variable randomized for trees in the forest. MDG is defined as the mean of the change in gini between a parent node and a child node when splitting on a variable across the whole forest.

These represent the most important features (based on MDG and MDA) that are statistically significant (based on Kolmogorov-Smirnov Test) for the differential expression between mets and non-mets patients (Table 55) and provides a biomarker library for prostate cancer progression.

In tables 53 and 54, those biomarkers from the 2,040 in the library that were found statistically significant in the training and testing sets based on a Wilcoxon test (p-value<=0.05) for the Area under the ROC curve (AUC) metric, are shown for Biochemical Recurrence Event (BCR) and Metastasis Event (Mets Event). Whereas results are shown for the testing set (as defined in Example 1), these biomarkers were significant also in the training set of the discovery study.

Further significance of the selected features was evidenced by multiple metrics and are also listed in tables 53 and 54. Metrics are defined in Example 12.

These results demonstrate, based on the multiple metrics shown, that the library of biomarkers built has the ability to capture the biology underlying the progression of prostate cancer, as defined by diverse clinical variables.

TABLE 53 biomarkers from the 2,040 biomarker library with significance for Wilcoxon P-value (auc.pvalue <= 0.05) and other metrics for the BCR event endpoint.

| SEQ ID NO. | auc | auc. pvalue | Sensi- tivity | Speci- ficity | Pos. Pred. Value | Neg. Pred. Value | KM P- value | Mva HRPval |
|---|---|---|---|---|---|---|---|---|
| 55 | 0.60 | 0.03 | 0.62 | 0.52 | 0.74 | 0.38 | 0.10 | 0.02 |
| 58 | 0.59 | 0.04 | 0.55 | 0.48 | 0.70 | 0.33 | 0.22 | 0.00 |
| 90 | 0.59 | 0.05 | 0.66 | 0.31 | 0.68 | 0.29 | 0.80 | 0.04 |
| 97 | 0.62 | 0.01 | 0.51 | 0.67 | 0.77 | 0.38 | 0.02 | 0.00 |
| 107 | 0.62 | 0.01 | 0.53 | 0.62 | 0.76 | 0.38 | 0.07 | 0.35 |
| 109 | 0.60 | 0.02 | 0.42 | 0.43 | 0.62 | 0.25 | 0.11 | 0.73 |
| 117 | 0.60 | 0.04 | 0.66 | 0.45 | 0.73 | 0.38 | 0.06 | 0.38 |
| 125 | 0.61 | 0.02 | 0.65 | 0.17 | 0.63 | 0.18 | 0.02 | 0.47 |
| 165 | 0.59 | 0.04 | 0.45 | 0.64 | 0.73 | 0.35 | 0.06 | 0.55 |
| 170 | 0.61 | 0.02 | 0.42 | 0.71 | 0.76 | 0.36 | 0.01 | 0.92 |
| 176 | 0.61 | 0.02 | 0.63 | 0.55 | 0.76 | 0.41 | 0.01 | 0.00 |
| 178 | 0.61 | 0.01 | 0.35 | 0.79 | 0.79 | 0.36 | 0.03 | 0.74 |
| 179 | 0.61 | 0.02 | 0.45 | 0.69 | 0.76 | 0.36 | 0.01 | 0.73 |
| 183 | 0.59 | 0.05 | 0.73 | 0.28 | 0.69 | 0.31 | 0.68 | 0.29 |
| 208 | 0.61 | 0.02 | 0.67 | 0.47 | 0.74 | 0.39 | 0.03 | 0.01 |
| 228 | 0.60 | 0.02 | 0.48 | 0.66 | 0.75 | 0.36 | 0.01 | 0.55 |
| 246 | 0.65 | 0.00 | 0.70 | 0.53 | 0.77 | 0.45 | 0.00 | 0.00 |
| 251 | 0.59 | 0.04 | 0.45 | 0.43 | 0.63 | 0.26 | 0.05 | 0.22 |
| 311 | 0.61 | 0.02 | 0.39 | 0.71 | 0.75 | 0.34 | 0.13 | 0.33 |
| 315 | 0.59 | 0.05 | 0.59 | 0.53 | 0.74 | 0.37 | 0.09 | 0.40 |
| 316 | 0.61 | 0.02 | 0.65 | 0.50 | 0.74 | 0.39 | 0.03 | 0.06 |
| 317 | 0.61 | 0.02 | 0.33 | 0.78 | 0.76 | 0.34 | 0.03 | 0.38 |
| 339 | 0.60 | 0.03 | 0.55 | 0.33 | 0.64 | 0.25 | 0.26 | 0.87 |
| 357 | 0.63 | 0.00 | 0.51 | 0.71 | 0.79 | 0.39 | 0.00 | 0.41 |
| 437 | 0.65 | 0.00 | 0.42 | 0.78 | 0.81 | 0.38 | 0.00 | 0.36 |
| 465 | 0.60 | 0.03 | 0.48 | 0.71 | 0.78 | 0.38 | 0.00 | 0.98 |
| 473 | 0.60 | 0.03 | 0.70 | 0.48 | 0.75 | 0.42 | 0.01 | 0.29 |
| 522 | 0.59 | 0.05 | 0.63 | 0.52 | 0.74 | 0.38 | 0.02 | 0.01 |
| 582 | 0.60 | 0.03 | 0.40 | 0.79 | 0.81 | 0.37 | 0.00 | 0.07 |
| 615 | 0.59 | 0.04 | 0.40 | 0.47 | 0.62 | 0.26 | 0.02 | 0.00 |
| 643 | 0.62 | 0.01 | 0.54 | 0.67 | 0.78 | 0.40 | 0.00 | 0.00 |
| 693 | 0.63 | 0.00 | 0.62 | 0.59 | 0.77 | 0.41 | 0.01 | 0.01 |
| 696 | 0.59 | 0.04 | 0.63 | 0.45 | 0.72 | 0.36 | 0.17 | 0.15 |
| 791 | 0.61 | 0.02 | 0.73 | 0.41 | 0.73 | 0.41 | 0.02 | 0.12 |
| 836 | 0.59 | 0.04 | 0.52 | 0.38 | 0.65 | 0.27 | 0.14 | 0.49 |
| 981 | 0.63 | 0.00 | 0.52 | 0.31 | 0.63 | 0.23 | 0.02 | 0.03 |
| 1024 | 0.59 | 0.04 | 0.58 | 0.48 | 0.71 | 0.34 | 0.12 | 0.00 |
| 1062 | 0.60 | 0.02 | 0.63 | 0.52 | 0.74 | 0.39 | 0.06 | 0.42 |
| 1094 | 0.60 | 0.02 | 0.48 | 0.34 | 0.62 | 0.23 | 0.03 | 0.52 |
| 1247 | 0.62 | 0.01 | 0.69 | 0.40 | 0.72 | 0.37 | 0.22 | 0.01 |
| 1249 | 0.61 | 0.02 | 0.48 | 0.41 | 0.64 | 0.26 | 0.03 | 0.17 |
| 1251 | 0.59 | 0.04 | 0.59 | 0.57 | 0.75 | 0.39 | 0.01 | 0.53 |
| 1270 | 0.59 | 0.04 | 0.47 | 0.67 | 0.76 | 0.36 | 0.05 | 0.16 |
| 1285 | 0.60 | 0.03 | 0.54 | 0.66 | 0.78 | 0.39 | 0.01 | 0.68 |
| 1378 | 0.61 | 0.02 | 0.36 | 0.53 | 0.63 | 0.27 | 0.06 | 0.02 |
| 1485 | 0.59 | 0.05 | 0.73 | 0.16 | 0.66 | 0.21 | 0.19 | 0.75 |
| 1509 | 0.60 | 0.01 | 0.43 | 0.36 | 0.60 | 0.22 | 0.02 | 0.02 |
| 1517 | 0.59 | 0.04 | 0.37 | 0.55 | 0.64 | 0.28 | 0.22 | 0.07 |
| 1537 | 0.60 | 0.02 | 0.57 | 0.59 | 0.75 | 0.38 | 0.00 | 0.45 |
| 1540 | 0.61 | 0.02 | 0.36 | 0.50 | 0.61 | 0.26 | 0.06 | 0.00 |
| 1541 | 0.62 | 0.01 | 0.69 | 0.50 | 0.75 | 0.42 | 0.01 | 0.01 |
| 1576 | 0.62 | 0.01 | 0.49 | 0.69 | 0.78 | 0.38 | 0.01 | 0.29 |
| 1581 | 0.59 | 0.05 | 0.52 | 0.60 | 0.74 | 0.36 | 0.18 | 0.24 |

TABLE 53-continued biomarkers from the 2,040 biomarker library with significance for Wilcoxon P-value (auc.pvalue <= 0.05) and other metrics for the BCR event endpoint.

| SEQ ID NO. | auc | auc. pvalue | Sensi- tivity | Speci- ficity | Pos. Pred. Value | Neg. Pred. Value | KM P- value | Mva HRPval |
|---|---|---|---|---|---|---|---|---|
| 1634 | 0.64 | 0.00 | 0.54 | 0.66 | 0.78 | 0.39 | 0.03 | 0.00 |
| 1656 | 0.60 | 0.03 | 0.36 | 0.76 | 0.77 | 0.35 | 0.02 | 0.54 |
| 1706 | 0.60 | 0.02 | 0.41 | 0.43 | 0.62 | 0.25 | 0.06 | 0.64 |
| 1719 | 0.60 | 0.02 | 0.50 | 0.64 | 0.75 | 0.37 | 0.00 | 0.17 |
| 1721 | 0.61 | 0.02 | 0.57 | 0.59 | 0.75 | 0.38 | 0.01 | 0.05 |
| 1783 | 0.61 | 0.02 | 0.63 | 0.53 | 0.75 | 0.39 | 0.02 | 0.83 |
| 1801 | 0.61 | 0.02 | 0.60 | 0.53 | 0.74 | 0.38 | 0.24 | 0.18 |
| 1823 | 0.61 | 0.02 | 0.37 | 0.48 | 0.61 | 0.26 | 0.05 | 0.21 |
| 1902 | 0.64 | 0.00 | 0.53 | 0.71 | 0.80 | 0.41 | 0.00 | 0.02 |
| 1958 | 0.60 | 0.03 | 0.67 | 0.50 | 0.75 | 0.41 | 0.00 | 0.00 |
| 1964 | 0.60 | 0.03 | 0.70 | 0.36 | 0.71 | 0.35 | 0.14 | 0.01 |
| 1965 | 0.62 | 0.01 | 0.47 | 0.71 | 0.78 | 0.38 | 0.00 | 0.84 |
| 2014 | 0.61 | 0.02 | 0.59 | 0.53 | 0.74 | 0.37 | 0.09 | 0.01 |

Auc.pvalue: Wilcoxon Test P-value.
KM: Kaplan Meier curves.
mvaHRPval: Multivariable Analysis Hazard Ratio P-value.

TABLE 54 biomarkers from the 2,040 biomarker library with significance for Wilcoxon P-value (auc.pvalue <= 0.05) and other metrics for the MET event endpoint.

| SEQ ID NO. | auc | auc. pvalue | Sensi- tivity | Speci- ficity | Pos. Pred. Value | Neg. Pred. Value | KM value | P-Mva HRPval |
|---|---|---|---|---|---|---|---|---|
| 50 | 0.65 | 0.00 | 0.32 | 0.42 | 0.24 | 0.52 | 0.00 | 0.14 |
| 51 | 0.64 | 0.00 | 0.59 | 0.58 | 0.45 | 0.71 | 0.01 | 0.02 |
| 53 | 0.69 | 0.00 | 0.78 | 0.47 | 0.46 | 0.79 | 0.00 | 0.00 |
| 55 | 0.60 | 0.02 | 0.65 | 0.47 | 0.41 | 0.70 | 0.11 | 0.10 |
| 58 | 0.65 | 0.00 | 0.63 | 0.51 | 0.43 | 0.71 | 0.03 | 0.00 |
| 59 | 0.63 | 0.00 | 0.76 | 0.44 | 0.44 | 0.76 | 0.00 | 0.39 |
| 60 | 0.63 | 0.00 | 0.71 | 0.50 | 0.45 | 0.75 | 0.01 | 0.05 |
| 63 | 0.60 | 0.03 | 0.59 | 0.55 | 0.43 | 0.70 | 0.04 | 0.15 |
| 68 | 0.59 | 0.04 | 0.81 | 0.40 | 0.44 | 0.78 | 0.00 | 0.46 |
| 71 | 0.60 | 0.02 | 0.46 | 0.42 | 0.31 | 0.57 | 0.06 | 0.09 |
| 76 | 0.60 | 0.03 | 0.81 | 0.37 | 0.43 | 0.77 | 0.01 | 0.25 |
| 82 | 0.63 | 0.00 | 0.68 | 0.55 | 0.46 | 0.75 | 0.00 | 0.03 |
| 87 | 0.59 | 0.05 | 0.82 | 0.31 | 0.41 | 0.75 | 0.03 | 0.04 |
| 90 | 0.63 | 0.00 | 0.74 | 0.37 | 0.40 | 0.71 | 0.08 | 0.07 |
| 96 | 0.62 | 0.01 | 0.78 | 0.38 | 0.42 | 0.75 | 0.01 | 0.02 |
| 97 | 0.67 | 0.00 | 0.60 | 0.64 | 0.49 | 0.74 | 0.00 | 0.00 |
| 100 | 0.63 | 0.00 | 0.32 | 0.42 | 0.24 | 0.52 | 0.00 | 0.07 |
| 102 | 0.60 | 0.02 | 0.66 | 0.45 | 0.41 | 0.70 | 0.09 | 0.00 |
| 107 | 0.61 | 0.01 | 0.57 | 0.57 | 0.43 | 0.70 | 0.09 | 0.10 |
| 108 | 0.60 | 0.02 | 0.50 | 0.66 | 0.46 | 0.70 | 0.01 | 0.13 |
| 117 | 0.61 | 0.01 | 0.71 | 0.42 | 0.41 | 0.71 | 0.06 | 0.02 |
| 119 | 0.61 | 0.01 | 0.75 | 0.41 | 0.42 | 0.74 | 0.02 | 0.04 |
| 120 | 0.59 | 0.05 | 0.76 | 0.36 | 0.41 | 0.73 | 0.04 | 0.19 |
| 126 | 0.59 | 0.04 | 0.46 | 0.37 | 0.30 | 0.54 | 0.02 | 0.28 |
| 130 | 0.63 | 0.00 | 0.65 | 0.56 | 0.46 | 0.73 | 0.00 | 0.12 |
| 131 | 0.59 | 0.05 | 0.60 | 0.53 | 0.42 | 0.70 | 0.04 | 0.02 |
| 137 | 0.60 | 0.02 | 0.43 | 0.69 | 0.45 | 0.68 | 0.09 | 0.13 |
| 144 | 0.59 | 0.05 | 0.63 | 0.54 | 0.44 | 0.72 | 0.02 | 0.73 |
| 151 | 0.63 | 0.00 | 0.56 | 0.70 | 0.52 | 0.73 | 0.00 | 0.23 |
| 152 | 0.69 | 0.00 | 0.60 | 0.63 | 0.48 | 0.73 | 0.00 | 0.00 |
| 155 | 0.61 | 0.01 | 0.56 | 0.49 | 0.39 | 0.66 | 0.68 | 0.24 |
| 163 | 0.61 | 0.02 | 0.63 | 0.54 | 0.44 | 0.72 | 0.03 | 0.14 |
| 165 | 0.65 | 0.00 | 0.53 | 0.64 | 0.46 | 0.70 | 0.02 | 0.04 |
| 169 | 0.59 | 0.04 | 0.68 | 0.52 | 0.45 | 0.73 | 0.01 | 0.08 |
| 170 | 0.63 | 0.00 | 0.51 | 0.69 | 0.49 | 0.71 | 0.00 | 0.13 |
| 175 | 0.59 | 0.04 | 0.74 | 0.40 | 0.41 | 0.72 | 0.05 | 0.02 |
| 176 | 0.60 | 0.02 | 0.69 | 0.49 | 0.44 | 0.73 | 0.01 | 0.01 |
| 179 | 0.66 | 0.00 | 0.57 | 0.69 | 0.51 | 0.74 | 0.00 | 0.36 |
| 183 | 0.60 | 0.02 | 0.79 | 0.31 | 0.40 | 0.73 | 0.08 | 0.07 |
| 187 | 0.62 | 0.01 | 0.76 | 0.40 | 0.42 | 0.75 | 0.02 | 0.01 |
| 188 | 0.61 | 0.01 | 0.43 | 0.40 | 0.29 | 0.55 | 0.03 | 0.88 |
| 192 | 0.64 | 0.00 | 0.35 | 0.40 | 0.25 | 0.52 | 0.00 | 0.12 |

TABLE 54-continued biomarkers from the 2,040 biomarker library with significance for Wilcoxon P-value (auc.pvalue <= 0.05) and other metrics for the MET event endpoint.

| SEQ ID NO. | auc | auc. pvalue | Sensitivity | Specificity | Pos. Pred. Value | Neg. Pred. Value | KM value | P-Mva HRPval |
|---|---|---|---|---|---|---|---|---|
| 197 | 0.60 | 0.02 | 0.53 | 0.61 | 0.44 | 0.69 | 0.02 | 0.01 |
| 204 | 0.59 | 0.05 | 0.79 | 0.30 | 0.39 | 0.71 | 0.22 | 0.94 |
| 213 | 0.59 | 0.04 | 0.68 | 0.48 | 0.43 | 0.72 | 0.02 | 0.01 |
| 225 | 0.64 | 0.00 | 0.74 | 0.47 | 0.44 | 0.75 | 0.01 | 0.02 |
| 228 | 0.64 | 0.00 | 0.59 | 0.65 | 0.49 | 0.73 | 0.00 | 0.06 |
| 230 | 0.61 | 0.01 | 0.40 | 0.45 | 0.29 | 0.56 | 0.06 | 0.39 |
| 239 | 0.61 | 0.02 | 0.69 | 0.47 | 0.43 | 0.73 | 0.01 | 0.02 |
| 241 | 0.59 | 0.03 | 0.50 | 0.37 | 0.31 | 0.56 | 0.10 | 0.93 |
| 246 | 0.65 | 0.00 | 0.82 | 0.48 | 0.48 | 0.83 | 0.00 | 0.01 |
| 251 | 0.59 | 0.05 | 0.37 | 0.45 | 0.28 | 0.55 | 0.02 | 0.30 |
| 255 | 0.60 | 0.02 | 0.62 | 0.60 | 0.47 | 0.73 | 0.00 | 0.34 |
| 268 | 0.59 | 0.05 | 0.65 | 0.51 | 0.43 | 0.71 | 0.02 | 0.10 |
| 269 | 0.59 | 0.04 | 0.72 | 0.42 | 0.42 | 0.72 | 0.03 | 0.02 |
| 271 | 0.63 | 0.00 | 0.41 | 0.41 | 0.29 | 0.55 | 0.01 | 0.51 |
| 273 | 0.59 | 0.04 | 0.40 | 0.44 | 0.29 | 0.56 | 0.03 | 0.20 |
| 275 | 0.59 | 0.05 | 0.38 | 0.51 | 0.31 | 0.59 | 0.11 | 0.05 |
| 277 | 0.60 | 0.02 | 0.47 | 0.45 | 0.33 | 0.60 | 0.25 | 0.02 |
| 285 | 0.65 | 0.00 | 0.38 | 0.36 | 0.25 | 0.50 | 0.00 | 0.47 |
| 288 | 0.62 | 0.01 | 0.53 | 0.57 | 0.41 | 0.68 | 0.13 | 0.05 |
| 291 | 0.61 | 0.02 | 0.59 | 0.53 | 0.42 | 0.69 | 0.08 | 0.19 |
| 292 | 0.63 | 0.00 | 0.54 | 0.28 | 0.30 | 0.52 | 0.01 | 0.02 |
| 293 | 0.59 | 0.04 | 0.54 | 0.38 | 0.34 | 0.59 | 0.35 | 0.62 |
| 299 | 0.59 | 0.05 | 0.62 | 0.53 | 0.43 | 0.71 | 0.04 | 0.08 |
| 314 | 0.60 | 0.03 | 0.34 | 0.53 | 0.29 | 0.58 | 0.06 | 0.01 |
| 317 | 0.66 | 0.00 | 0.41 | 0.77 | 0.51 | 0.69 | 0.00 | 0.07 |
| 333 | 0.60 | 0.02 | 0.75 | 0.27 | 0.37 | 0.65 | 0.61 | 0.05 |
| 336 | 0.60 | 0.02 | 0.56 | 0.35 | 0.33 | 0.58 | 0.28 | 0.42 |
| 344 | 0.60 | 0.03 | 0.78 | 0.37 | 0.42 | 0.75 | 0.02 | 0.00 |
| 350 | 0.60 | 0.03 | 0.59 | 0.57 | 0.44 | 0.71 | 0.02 | 0.18 |
| 352 | 0.61 | 0.01 | 0.43 | 0.41 | 0.29 | 0.55 | 0.02 | 0.00 |
| 356 | 0.60 | 0.02 | 0.71 | 0.42 | 0.41 | 0.71 | 0.09 | 0.11 |
| 357 | 0.64 | 0.00 | 0.54 | 0.62 | 0.45 | 0.70 | 0.02 | 0.03 |
| 360 | 0.60 | 0.02 | 0.50 | 0.36 | 0.31 | 0.55 | 0.05 | 0.92 |
| 362 | 0.65 | 0.00 | 0.62 | 0.59 | 0.47 | 0.73 | 0.00 | 0.04 |
| 367 | 0.60 | 0.02 | 0.59 | 0.51 | 0.41 | 0.68 | 0.14 | 0.09 |
| 371 | 0.60 | 0.02 | 0.50 | 0.33 | 0.30 | 0.53 | 0.01 | 0.04 |
| 373 | 0.60 | 0.03 | 0.75 | 0.31 | 0.38 | 0.68 | 0.39 | 0.08 |
| 383 | 0.62 | 0.01 | 0.50 | 0.62 | 0.43 | 0.68 | 0.13 | 0.15 |
| 394 | 0.60 | 0.03 | 6.54 | 0.31 | 0.31 | 0.54 | 0.06 | 0.43 |
| 397 | 0.61 | 0.01 | 0.59 | 0.57 | 0.44 | 0.71 | 0.04 | 0.14 |
| 400 | 0.60 | 0.03 | 0.69 | 0.45 | 0.42 | 0.72 | 0.05 | 0.24 |
| 409 | 0.60 | 0.02 | 0.54 | 0.58 | 0.43 | 0.69 | 0.03 | 0.10 |
| 418 | 0.62 | 0.01 | 0.68 | 0.47 | 0.42 | 0.71 | 0.02 | 0.01 |
| 419 | 0.64 | 0.00 | 0.69 | 0.57 | 0.48 | 0.76 | 0.00 | 0.01 |
| 425 | 0.59 | 0.04 | 0.60 | 0.47 | 0.40 | 0.67 | 0.25 | 0.08 |
| 441 | 0.61 | 0.02 | 0.81 | 0.34 | 0.41 | 0.75 | 0.03 | 0.10 |
| 445 | 0.60 | 0.02 | 0.59 | 0.53 | 0.42 | 0.69 | 0.06 | 0.22 |
| 447 | 0.62 | 0.01 | 0.60 | 0.58 | 0.45 | 0.72 | 0.01 | 0.08 |
| 459 | 0.59 | 0.05 | 0.44 | 0.46 | 0.32 | 0.59 | 0.27 | 0.22 |
| 466 | 0.59 | 0.04 | 0.28 | 0.58 | 0.28 | 0.58 | 0.05 | 0.03 |
| 473 | 0.59 | 0.04 | 0.76 | 0.42 | 0.43 | 0.76 | 0.01 | 0.48 |
| 477 | 0.61 | 0.01 | 0.46 | 0.75 | 0.52 | 0.71 | 0.00 | 0.12 |
| 478 | 0.60 | 0.02 | 0.66 | 0.47 | 0.42 | 0.71 | 0.04 | 0.04 |
| 484 | 0.62 | 0.01 | 0.75 | 0.44 | 0.44 | 0.75 | 0.01 | 0.10 |
| 485 | 0.61 | 0.02 | 0.29 | 0.53 | 0.26 | 0.56 | 0.02 | 0.19 |
| 493 | 0.61 | 0.01 | 0.59 | 0.55 | 0.43 | 0.70 | 0.03 | 0.40 |
| 494 | 0.61 | 0.01 | 0.74 | 0.36 | 0.40 | 0.70 | 0.13 | 0.23 |
| 500 | 0.59 | 0.05 | 0.71 | 0.39 | 0.40 | 0.70 | 0.17 | 0.08 |
| 509 | 0.60 | 0.03 | 0.32 | 0.50 | 0.27 | 0.56 | 0.02 | 0.58 |
| 516 | 0.65 | 0.00 | 0.28 | 0.53 | 0.25 | 0.56 | 0.01 | 0.03 |
| 517 | 0.59 | 0.04 | 0.62 | 0.52 | 0.42 | 0.70 | 0.04 | 0.05 |
| 522 | 0.62 | 0.01 | 0.69 | 0.48 | 0.44 | 0.73 | 0.01 | 0.14 |
| 539 | 0.66 | 0.00 | 0.75 | 0.45 | 0.44 | 0.76 | 0.00 | 0.00 |
| 548 | 0.61 | 0.01 | 0.71 | 0.42 | 0.41 | 0.71 | 0.08 | 0.07 |
| 552 | 0.61 | 0.01 | 0.68 | 0.47 | 0.42 | 0.71 | 0.03 | 0.03 |
| 559 | 0.62 | 0.01 | 0.37 | 0.40 | 0.26 | 0.52 | 0.00 | 0.00 |
| 563 | 0.59 | 0.04 | 0.35 | 0.46 | 0.27 | 0.55 | 0.01 | 0.68 |
| 568 | 0.61 | 0.01 | 0.75 | 0.37 | 0.41 | 0.72 | 0.06 | 0.07 |
| 571 | 0.60 | 0.02 | 0.72 | 0.41 | 0.41 | 0.72 | 0.04 | 0.07 |
| 572 | 0.65 | 0.00 | 0.65 | 0.56 | 0.46 | 0.73 | 0.00 | 0.01 |
| 579 | 0.60 | 0.02 | 0.72 | 0.42 | 0.42 | 0.72 | 0.03 | 0.03 |
| 582 | 0.68 | 0.00 | 0.54 | 0.78 | 0.59 | 0.75 | 0.00 | 0.00 |
| 586 | 0.61 | 0.02 | 0.44 | 0.38 | 0.29 | 0.54 | 0.02 | 0.04 |
| 589 | 0.60 | 0.02 | 0.49 | 0.39 | 0.31 | 0.57 | 0.14 | 0.91 |
| 614 | 0.64 | 0.00 | 0.75 | 0.44 | 0.44 | 0.75 | 0.01 | 0.11 |
| 616 | 0.61 | 0.01 | 0.63 | 0.54 | 0.44 | 0.72 | 0.01 | 0.87 |
| 618 | 0.62 | 0.01 | 0.60 | 0.54 | 0.43 | 0.70 | 0.04 | 0.01 |
| 639 | 0.63 | 0.00 | 0.66 | 0.56 | 0.46 | 0.74 | 0.00 | 0.03 |
| 643 | 0.60 | 0.03 | 0.57 | 0.58 | 0.44 | 0.70 | 0.02 | 0.00 |
| 645 | 0.64 | 0.00 | 0.53 | 0.61 | 0.44 | 0.69 | 0.04 | 0.04 |
| 650 | 0.63 | 0.00 | 0.35 | 0.43 | 0.26 | 0.54 | 0.01 | 0.37 |
| 671 | 0.62 | 0.01 | 0.43 | 0.37 | 0.28 | 0.53 | 0.01 | 0.08 |
| 688 | 0.59 | 0.05 | 0.72 | 0.41 | 0.41 | 0.72 | 0.05 | 0.00 |
| 693 | 0.64 | 0.00 | 0.68 | 0.52 | 0.45 | 0.73 | 0.01 | 0.00 |
| 695 | 0.60 | 0.03 | 0.63 | 0.50 | 0.42 | 0.70 | 0.03 | 0.11 |
| 696 | 0.64 | 0.00 | 0.71 | 0.45 | 0.42 | 0.73 | 0.04 | 0.02 |
| 698 | 0.59 | 0.04 | 0.68 | 0.48 | 0.43 | 0.72 | 0.02 | 0.02 |
| 704 | 0.59 | 0.03 | 0.76 | 0.36 | 0.41 | 0.72 | 0.05 | 0.02 |
| 707 | 0.59 | 0.03 | 0.50 | 0.32 | 0.30 | 0.53 | 0.01 | 0.99 |
| 717 | 0.59 | 0.04 | 0.54 | 0.34 | 0.32 | 0.56 | 0.07 | 0.33 |
| 721 | 0.63 | 0.00 | 0.82 | 0.34 | 0.42 | 0.77 | 0.02 | 0.00 |
| 724 | 0.60 | 0.03 | 0.38 | 0.51 | 0.31 | 0.59 | 0.11 | 0.51 |
| 729 | 0.60 | 0.02 | 0.43 | 0.41 | 0.29 | 0.55 | 0.02 | 0.11 |
| 733 | 0.59 | 0.04 | 0.60 | 0.56 | 0.44 | 0.71 | 0.01 | 0.16 |
| 737 | 0.60 | 0.02 | 0.26 | 0.60 | 0.28 | 0.59 | 0.05 | 0.07 |
| 752 | 0.60 | 0.03 | 0.56 | 0.31 | 0.32 | 0.55 | 0.09 | 0.09 |
| 760 | 0.60 | 0.03 | 0.66 | 0.52 | 0.44 | 0.73 | 0.02 | 0.91 |
| 761 | 0.62 | 0.01 | 0.68 | 0.49 | 0.43 | 0.73 | 0.02 | 0.24 |
| 772 | 0.66 | 0.00 | 0.71 | 0.55 | 0.48 | 0.76 | 0.00 | 0.00 |
| 799 | 0.60 | 0.02 | 0.68 | 0.47 | 0.43 | 0.72 | 0.05 | 0.75 |
| 802 | 0.59 | 0.04 | 0.72 | 0.41 | 0.41 | 0.72 | 0.09 | 0.02 |
| 804 | 0.60 | 0.02 | 0.29 | 0.58 | 0.29 | 0.59 | 0.08 | 0.01 |
| 816 | 0.59 | 0.05 | 0.62 | 0.56 | 0.45 | 0.72 | 0.03 | 0.41 |
| 821 | 0.59 | 0.04 | 0.71 | 0.34 | 0.38 | 0.67 | 0.42 | 0.11 |
| 825 | 0.59 | 0.03 | 0.62 | 0.50 | 0.42 | 0.69 | 0.06 | 0.29 |
| 826 | 0.61 | 0.01 | 0.65 | 0.58 | 0.47 | 0.74 | 0.00 | 0.12 |
| 830 | 0.59 | 0.03 | 0.29 | 0.58 | 0.29 | 0.59 | 0.04 | 0.11 |
| 836 | 0.61 | 0.01 | 0.47 | 0.40 | 0.31 | 0.57 | 0.09 | 0.13 |
| 840 | 0.62 | 0.00 | 0.75 | 0.37 | 0.41 | 0.72 | 0.05 | 0.03 |
| 845 | 0.64 | 0.00 | 0.59 | 0.62 | 0.47 | 0.72 | 0.01 | 0.04 |
| 863 | 0.60 | 0.03 | 0.79 | 0.29 | 0.39 | 0.71 | 0.20 | 0.21 |
| 864 | 0.64 | 0.00 | 0.68 | 0.55 | 0.46 | 0.75 | 0.00 | 0.01 |
| 884 | 0.59 | 0.04 | 0.65 | 0.49 | 0.42 | 0.71 | 0.08 | 0.08 |
| 887 | 0.61 | 0.01 | 0.53 | 0.57 | 0.41 | 0.68 | 0.15 | 0.00 |
| 889 | 0.61 | 0.01 | 0.38 | 0.49 | 0.30 | 0.58 | 0.11 | 0.59 |
| 892 | 0.59 | 0.03 | 0.56 | 0.57 | 0.43 | 0.69 | 0.11 | 0.11 |
| 901 | 0.59 | 0.04 | 0.49 | 0.60 | 0.41 | 0.67 | 0.18 | 0.06 |
| 913 | 0.62 | 0.01 | 0.72 | 0.41 | 0.41 | 0.72 | 0.04 | 0.01 |
| 920 | 0.61 | 0.01 | 0.84 | 0.21 | 0.38 | 0.69 | 0.34 | 0.08 |
| 921 | 0.60 | 0.02 | 0.25 | 0.53 | 0.23 | 0.55 | 0.00 | 0.82 |
| 924 | 0.61 | 0.02 | 0.75 | 0.42 | 0.43 | 0.75 | 0.01 | 0.28 |
| 950 | 0.59 | 0.03 | 0.69 | 0.44 | 0.42 | 0.71 | 0.07 | 0.09 |
| 959 | 0.66 | 0.00 | 0.54 | 0.30 | 0.31 | 0.53 | 0.03 | 0.21 |
| 967 | 0.59 | 0.04 | 0.65 | 0.47 | 0.41 | 0.70 | 0.13 | 0.05 |
| 971 | 0.62 | 0.01 | 0.24 | 0.53 | 0.23 | 0.55 | 0.00 | 0.34 |
| 977 | 0.59 | 0.04 | 0.41 | 0.42 | 0.29 | 0.55 | 0.02 | 0.10 |
| 979 | 0.59 | 0.04 | 0.57 | 0.31 | 0.32 | 0.55 | 0.10 | 0.55 |
| 981 | 0.62 | 0.01 | 0.46 | 0.36 | 0.29 | 0.53 | 0.01 | 0.44 |
| 988 | 0.64 | 0.00 | 0.56 | 0.62 | 0.46 | 0.71 | 0.01 | 0.01 |
| 993 | 0.61 | 0.01 | 0.66 | 0.54 | 0.45 | 0.74 | 0.00 | 0.00 |
| 997 | 0.59 | 0.04 | 0.51 | 0.31 | 0.30 | 0.53 | 0.01 | 0.07 |
| 1001 | 0.63 | 0.00 | 0.66 | 0.58 | 0.47 | 0.75 | 0.00 | 0.08 |
| 1005 | 0.63 | 0.00 | 0.68 | 0.45 | 0.41 | 0.71 | 0.13 | 0.62 |
| 1008 | 0.61 | 0.01 | 0.62 | 0.53 | 0.43 | 0.71 | 0.04 | 0.09 |
| 1024 | 0.59 | 0.04 | 0.59 | 0.46 | 0.38 | 0.66 | 0.29 | 0.02 |
| 1032 | 0.60 | 0.02 | 0.38 | 0.43 | 0.28 | 0.55 | 0.01 | 0.14 |
| 1036 | 0.61 | 0.01 | 0.65 | 0.48 | 0.42 | 0.70 | 0.04 | 0.01 |
| 1047 | 0.59 | 0.04 | 0.50 | 0.35 | 0.31 | 0.55 | 0.03 | 0.00 |
| 1051 | 0.63 | 0.00 | 0.43 | 0.39 | 0.29 | 0.54 | 0.01 | 0.12 |
| 1055 | 0.64 | 0.00 | 0.68 | 0.52 | 0.45 | 0.73 | 0.01 | 0.08 |
| 1066 | 0.59 | 0.04 | 0.72 | 0.42 | 0.42 | 0.72 | 0.04 | 0.05 |
| 1070 | 0.60 | 0.03 | 0.68 | 0.37 | 0.38 | 0.67 | 0.28 | 0.14 |
| 1078 | 0.61 | 0.01 | 0.49 | 0.65 | 0.45 | 0.69 | 0.10 | 0.00 |
| 1079 | 0.64 | 0.00 | 0.79 | 0.42 | 0.44 | 0.78 | 0.00 | 0.02 |

TABLE 54-continued biomarkers from the 2,040 biomarker library with significance for Wilcoxon P-value (auc.pvalue <= 0.05) and other metrics for the MET event endpoint.

| SEQ ID NO. | auc | auc. pvalue | Sensi-tivity | Speci-ficity | Pos. Pred. Value | Neg. Pred. Value | KM value | P-Mva HRPval |
|---|---|---|---|---|---|---|---|---|
| 1084 | 0.60 | 0.02 | 0.75 | 0.41 | 0.42 | 0.74 | 0.02 | 0.27 |
| 1094 | 0.63 | 0.00 | 0.40 | 0.38 | 0.27 | 0.52 | 0.00 | 0.91 |
| 1104 | 0.60 | 0.02 | 0.34 | 0.50 | 0.28 | 0.57 | 0.04 | 0.18 |
| 1116 | 0.59 | 0.04 | 0.62 | 0.47 | 0.40 | 0.68 | 0.22 | 0.50 |
| 1122 | 0.63 | 0.00 | 0.69 | 0.37 | 0.39 | 0.68 | 0.26 | 0.02 |
| 1130 | 0.61 | 0.01 | 0.41 | 0.46 | 0.30 | 0.57 | 0.09 | 0.61 |
| 1145 | 0.61 | 0.01 | 0.75 | 0.39 | 0.41 | 0.73 | 0.04 | 0.06 |
| 1161 | 0.62 | 0.01 | 0.57 | 0.60 | 0.45 | 0.71 | 0.02 | 0.00 |
| 1164 | 0.65 | 0.00 | 0.71 | 0.53 | 0.46 | 0.76 | 0.00 | 0.00 |
| 1166 | 0.61 | 0.01 | 0.56 | 0.61 | 0.45 | 0.71 | 0.02 | 0.01 |
| 1169 | 0.60 | 0.03 | 0.82 | 0.27 | 0.39 | 0.73 | 0.08 | 0.03 |
| 1171 | 0.60 | 0.03 | 0.28 | 0.52 | 0.25 | 0.55 | 0.01 | 0.78 |
| 1194 | 0.59 | 0.04 | 0.75 | 0.41 | 0.42 | 0.74 | 0.04 | 0.64 |
| 1200 | 0.59 | 0.04 | 0.62 | 0.51 | 0.42 | 0.70 | 0.07 | 0.02 |
| 1203 | 0.62 | 0.00 | 0.34 | 0.47 | 0.27 | 0.55 | 0.01 | 0.77 |
| 1206 | 0.61 | 0.01 | 0.74 | 0.40 | 0.41 | 0.72 | 0.09 | 0.09 |
| 1215 | 0.63 | 0.00 | 0.65 | 0.53 | 0.44 | 0.72 | 0.01 | 0.13 |
| 1227 | 0.60 | 0.02 | 0.66 | 0.47 | 0.42 | 0.71 | 0.03 | 0.13 |
| 1241 | 0.59 | 0.04 | 0.46 | 0.41 | 0.31 | 0.56 | 0.11 | 0.78 |
| 1249 | 0.60 | 0.02 | 0.40 | 0.42 | 0.28 | 0.55 | 0.01 | 0.16 |
| 1251 | 0.64 | 0.00 | 0.68 | 0.53 | 0.46 | 0.74 | 0.01 | 0.17 |
| 1257 | 0.61 | 0.02 | 0.51 | 0.34 | 0.31 | 0.55 | 0.05 | 0.91 |
| 1259 | 0.60 | 0.03 | 0.65 | 0.53 | 0.44 | 0.72 | 0.01 | 0.02 |
| 1270 | 0.60 | 0.02 | 0.50 | 0.62 | 0.43 | 0.68 | 0.05 | 0.02 |
| 1277 | 0.60 | 0.02 | 0.76 | 0.38 | 0.42 | 0.74 | 0.05 | 0.24 |
| 1290 | 0.60 | 0.03 | 0.68 | 0.53 | 0.45 | 0.74 | 0.01 | 0.05 |
| 1291 | 0.60 | 0.02 | 0.46 | 0.42 | 0.31 | 0.57 | 0.09 | 0.38 |
| 1294 | 0.61 | 0.02 | 0.75 | 0.27 | 0.37 | 0.65 | 0.52 | 0.06 |
| 1299 | 0.60 | 0.02 | 0.53 | 0.29 | 0.30 | 0.52 | 0.01 | 0.07 |
| 1307 | 0.59 | 0.04 | 0.75 | 0.35 | 0.40 | 0.71 | 0.09 | 0.11 |
| 1311 | 0.60 | 0.02 | 0.71 | 0.39 | 0.40 | 0.70 | 0.10 | 0.02 |
| 1319 | 0.59 | 0.05 | 0.87 | 0.19 | 0.38 | 0.72 | 0.19 | 0.11 |
| 1323 | 0.62 | 0.01 | 0.57 | 0.57 | 0.43 | 0.70 | 0.09 | 0.32 |
| 1324 | 0.66 | 0.00 | 0.59 | 0.60 | 0.46 | 0.72 | 0.02 | 0.15 |
| 1332 | 0.59 | 0.04 | 0.44 | 0.40 | 0.30 | 0.55 | 0.01 | 0.01 |
| 1336 | 0.59 | 0.04 | 0.69 | 0.43 | 0.41 | 0.71 | 0.08 | 0.09 |
| 1337 | 0.59 | 0.05 | 0.65 | 0.48 | 0.42 | 0.70 | 0.06 | 0.29 |
| 1339 | 0.64 | 0.00 | 0.82 | 0.34 | 0.42 | 0.77 | 0.01 | 0.04 |
| 1343 | 0.60 | 0.02 | 0.84 | 0.31 | 0.41 | 0.77 | 0.02 | 0.15 |
| 1348 | 0.61 | 0.01 | 0.21 | 0.56 | 0.21 | 0.55 | 0.00 | 0.87 |
| 1355 | 0.62 | 0.01 | 0.59 | 0.31 | 0.33 | 0.56 | 0.13 | 0.36 |
| 1366 | 0.61 | 0.01 | 0.78 | 0.41 | 0.43 | 0.76 | 0.01 | 0.09 |
| 1369 | 0.66 | 0.00 | 0.62 | 0.56 | 0.45 | 0.72 | 0.02 | 0.26 |
| 1378 | 0.64 | 0.00 | 0.25 | 0.53 | 0.23 | 0.55 | 0.00 | 0.01 |
| 1379 | 0.61 | 0.02 | 0.60 | 0.52 | 0.42 | 0.69 | 0.06 | 0.18 |
| 1380 | 0.60 | 0.02 | 0.63 | 0.48 | 0.41 | 0.70 | 0.11 | 0.13 |
| 1383 | 0.60 | 0.02 | 0.38 | 0.72 | 0.44 | 0.67 | 0.11 | 0.08 |
| 1388 | 0.61 | 0.02 | 0.68 | 0.42 | 0.40 | 0.69 | 0.17 | 0.12 |
| 1403 | 0.62 | 0.01 | 0.22 | 0.66 | 0.27 | 0.60 | 0.09 | 0.23 |
| 1405 | 0.60 | 0.02 | 0.78 | 0.34 | 0.40 | 0.73 | 0.07 | 0.24 |
| 1408 | 0.60 | 0.03 | 0.69 | 0.41 | 0.40 | 0.70 | 0.10 | 0.06 |
| 1413 | 0.61 | 0.02 | 0.65 | 0.55 | 0.45 | 0.73 | 0.00 | 0.11 |
| 1417 | 0.61 | 0.01 | 0.38 | 0.37 | 0.26 | 0.51 | 0.00 | 0.41 |
| 1421 | 0.60 | 0.02 | 0.68 | 0.47 | 0.42 | 0.71 | 0.02 | 0.01 |
| 1428 | 0.59 | 0.04 | 0.43 | 0.42 | 0.30 | 0.56 | 0.03 | 0.01 |
| 1439 | 0.60 | 0.02 | 0.47 | 0.42 | 0.32 | 0.58 | 0.19 | 0.97 |
| 1447 | 0.59 | 0.04 | 0.59 | 0.31 | 0.33 | 0.56 | 0.07 | 0.43 |
| 1451 | 0.63 | 0.00 | 0.74 | 0.43 | 0.43 | 0.74 | 0.01 | 0.19 |
| 1458 | 0.59 | 0.05 | 0.50 | 0.42 | 0.33 | 0.60 | 0.30 | 0.61 |
| 1465 | 0.61 | 0.01 | 0.40 | 0.47 | 0.30 | 0.58 | 0.06 | 0.00 |
| 1477 | 0.61 | 0.01 | 0.41 | 0.43 | 0.29 | 0.56 | 0.06 | 0.12 |
| 1480 | 0.59 | 0.04 | 0.62 | 0.50 | 0.42 | 0.69 | 0.09 | 0.21 |
| 1491 | 0.63 | 0.00 | 0.46 | 0.37 | 0.30 | 0.54 | 0.03 | 0.01 |
| 1500 | 0.60 | 0.03 | 0.63 | 0.53 | 0.44 | 0.72 | 0.01 | 0.21 |
| 1502 | 0.60 | 0.02 | 0.68 | 0.46 | 0.42 | 0.71 | 0.04 | 0.02 |
| 1509 | 0.65 | 0.00 | 0.34 | 0.42 | 0.25 | 0.52 | 0.00 | 0.03 |
| 1514 | 0.59 | 0.04 | 0.57 | 0.58 | 0.44 | 0.70 | 0.04 | 0.30 |
| 1517 | 0.63 | 0.00 | 0.28 | 0.54 | 0.26 | 0.57 | 0.02 | 0.04 |
| 1523 | 0.59 | 0.05 | 0.43 | 0.45 | 0.31 | 0.58 | 0.04 | 0.06 |
| 1524 | 0.66 | 0.00 | 0.49 | 0.71 | 0.49 | 0.71 | 0.00 | 0.03 |
| 1528 | 0.60 | 0.02 | 0.57 | 0.51 | 0.40 | 0.67 | 0.25 | 0.02 |
| 1535 | 0.61 | 0.01 | 0.60 | 0.64 | 0.49 | 0.74 | 0.00 | 0.27 |
| 1537 | 0.63 | 0.00 | 0.65 | 0.55 | 0.45 | 0.73 | 0.01 | 0.10 |
| 1540 | 0.62 | 0.01 | 0.31 | 0.54 | 0.28 | 0.58 | 0.05 | 0.00 |
| 1541 | 0.62 | 0.00 | 0.75 | 0.44 | 0.44 | 0.75 | 0.00 | 0.01 |
| 1543 | 0.59 | 0.04 | 0.57 | 0.52 | 0.41 | 0.68 | 0.20 | 0.15 |
| 1547 | 0.67 | 0.00 | 0.60 | 0.67 | 0.51 | 0.75 | 0.00 | 0.00 |
| 1549 | 0.63 | 0.00 | 0.59 | 0.58 | 0.45 | 0.71 | 0.02 | 0.14 |
| 1554 | 0.59 | 0.05 | 0.59 | 0.47 | 0.39 | 0.67 | 0.34 | 0.22 |
| 1558 | 0.60 | 0.02 | 0.66 | 0.46 | 0.41 | 0.70 | 0.09 | 0.12 |
| 1559 | 0.64 | 0.00 | 0.66 | 0.57 | 0.47 | 0.74 | 0.00 | 0.00 |
| 1563 | 0.61 | 0.02 | 0.68 | 0.44 | 0.41 | 0.70 | 0.09 | 0.06 |
| 1566 | 0.62 | 0.00 | 0.38 | 0.47 | 0.29 | 0.57 | 0.04 | 0.04 |
| 1576 | 0.59 | 0.04 | 0.49 | 0.59 | 0.41 | 0.67 | 0.18 | 0.13 |
| 1578 | 0.64 | 0.00 | 0.44 | 0.72 | 0.48 | 0.69 | 0.02 | 0.10 |
| 1580 | 0.60 | 0.02 | 0.66 | 0.47 | 0.42 | 0.71 | 0.13 | 0.14 |
| 1583 | 0.61 | 0.01 | 0.81 | 0.34 | 0.41 | 0.75 | 0.03 | 0.04 |
| 1586 | 0.59 | 0.04 | 0.63 | 0.47 | 0.41 | 0.69 | 0.20 | 0.02 |
| 1588 | 0.60 | 0.02 | 0.62 | 0.47 | 0.40 | 0.68 | 0.15 | 0.00 |
| 1593 | 0.64 | 0.00 | 0.59 | 0.69 | 0.52 | 0.74 | 0.00 | 0.16 |
| 1595 | 0.61 | 0.01 | 0.65 | 0.47 | 0.42 | 0.70 | 0.07 | 0.01 |
| 1600 | 0.61 | 0.02 | 0.66 | 0.51 | 0.44 | 0.72 | 0.02 | 0.03 |
| 1606 | 0.61 | 0.01 | 0.38 | 0.42 | 0.27 | 0.54 | 0.01 | 0.49 |
| 1615 | 0.61 | 0.01 | 0.60 | 0.49 | 0.41 | 0.68 | 0.15 | 0.03 |
| 1623 | 0.59 | 0.05 | 0.41 | 0.48 | 0.31 | 0.59 | 0.16 | 0.79 |
| 1628 | 0.61 | 0.01 | 0.29 | 0.51 | 0.26 | 0.56 | 0.01 | 0.85 |
| 1634 | 0.64 | 0.00 | 0.59 | 0.58 | 0.45 | 0.71 | 0.02 | 0.00 |
| 1642 | 0.63 | 0.00 | 0.75 | 0.43 | 0.43 | 0.75 | 0.01 | 0.24 |
| 1646 | 0.60 | 0.02 | 0.78 | 0.42 | 0.43 | 0.77 | 0.00 | 0.06 |
| 1651 | 0.60 | 0.03 | 0.50 | 0.42 | 0.33 | 0.59 | 0.17 | 0.84 |
| 1656 | 0.61 | 0.01 | 0.47 | 0.76 | 0.53 | 0.71 | 0.00 | 0.12 |
| 1660 | 0.59 | 0.04 | 0.78 | 0.39 | 0.42 | 0.75 | 0.01 | 0.09 |
| 1663 | 0.60 | 0.02 | 0.57 | 0.61 | 0.46 | 0.71 | 0.01 | 0.11 |
| 1671 | 0.61 | 0.01 | 0.68 | 0.52 | 0.45 | 0.73 | 0.00 | 0.04 |
| 1681 | 0.61 | 0.01 | 0.65 | 0.57 | 0.46 | 0.74 | 0.00 | 0.31 |
| 1683 | 0.60 | 0.03 | 0.72 | 0.45 | 0.43 | 0.74 | 0.01 | 0.07 |
| 1691 | 0.63 | 0.00 | 0.87 | 0.24 | 0.40 | 0.76 | 0.08 | 0.00 |
| 1694 | 0.59 | 0.04 | 0.71 | 0.45 | 0.42 | 0.73 | 0.03 | 0.38 |
| 1704 | 0.62 | 0.01 | 0.41 | 0.80 | 0.54 | 0.70 | 0.00 | 0.69 |
| 1705 | 0.61 | 0.01 | 0.43 | 0.42 | 0.30 | 0.56 | 0.05 | 0.79 |
| 1712 | 0.62 | 0.00 | 0.74 | 0.51 | 0.46 | 0.77 | 0.00 | 0.06 |
| 1718 | 0.63 | 0.00 | 0.50 | 0.64 | 0.44 | 0.69 | 0.04 | 0.00 |
| 1719 | 0.64 | 0.00 | 0.57 | 0.61 | 0.46 | 0.71 | 0.01 | 0.09 |
| 1720 | 0.62 | 0.01 | 0.54 | 0.23 | 0.29 | 0.47 | 0.00 | 0.17 |
| 1721 | 0.64 | 0.00 | 0.65 | 0.55 | 0.45 | 0.73 | 0.00 | 0.02 |
| 1722 | 0.59 | 0.04 | 0.57 | 0.51 | 0.40 | 0.67 | 0.31 | 0.05 |
| 1734 | 0.60 | 0.02 | 0.49 | 0.63 | 0.43 | 0.68 | 0.08 | 0.06 |
| 1738 | 0.61 | 0.01 | 0.79 | 0.35 | 0.41 | 0.75 | 0.02 | 0.05 |
| 1742 | 0.64 | 0.00 | 0.63 | 0.57 | 0.46 | 0.73 | 0.00 | 0.03 |
| 1756 | 0.60 | 0.03 | 0.56 | 0.63 | 0.46 | 0.71 | 0.01 | 0.00 |
| 1757 | 0.61 | 0.02 | 0.57 | 0.56 | 0.43 | 0.69 | 0.04 | 0.02 |
| 1764 | 0.59 | 0.05 | 0.85 | 0.26 | 0.40 | 0.76 | 0.07 | 0.02 |
| 1778 | 0.60 | 0.03 | 0.76 | 0.32 | 0.39 | 0.70 | 0.19 | 0.03 |
| 1782 | 0.62 | 0.01 | 0.69 | 0.49 | 0.44 | 0.73 | 0.01 | 0.01 |
| 1783 | 0.66 | 0.00 | 0.74 | 0.52 | 0.47 | 0.77 | 0.00 | 0.00 |
| 1784 | 0.59 | 0.03 | 0.76 | 0.36 | 0.41 | 0.72 | 0.04 | 0.02 |
| 1790 | 0.63 | 0.00 | 0.72 | 0.52 | 0.46 | 0.76 | 0.00 | 0.03 |
| 1798 | 0.59 | 0.04 | 0.56 | 0.64 | 0.48 | 0.72 | 0.00 | 0.04 |
| 1806 | 0.61 | 0.01 | 0.28 | 0.50 | 0.24 | 0.55 | 0.00 | 0.31 |
| 1814 | 0.63 | 0.00 | 0.43 | 0.35 | 0.27 | 0.51 | 0.00 | 0.20 |
| 1816 | 0.63 | 0.00 | 0.62 | 0.58 | 0.46 | 0.73 | 0.00 | 0.04 |
| 1819 | 0.61 | 0.01 | 0.71 | 0.48 | 0.44 | 0.74 | 0.00 | 0.12 |
| 1820 | 0.62 | 0.01 | 0.49 | 0.66 | 0.45 | 0.69 | 0.02 | 0.07 |
| 1821 | 0.59 | 0.05 | 0.57 | 0.59 | 0.45 | 0.71 | 0.03 | 0.44 |
| 1823 | 0.64 | 0.00 | 0.28 | 0.51 | 0.25 | 0.55 | 0.00 | 0.16 |
| 1824 | 0.61 | 0.01 | 0.49 | 0.67 | 0.46 | 0.69 | 0.01 | 0.08 |
| 1833 | 0.63 | 0.00 | 0.76 | 0.43 | 0.44 | 0.76 | 0.00 | 0.00 |
| 1836 | 0.60 | 0.03 | 0.68 | 0.43 | 0.41 | 0.70 | 0.09 | 0.02 |
| 1837 | 0.61 | 0.01 | 0.54 | 0.59 | 0.44 | 0.69 | 0.07 | 0.06 |
| 1838 | 0.59 | 0.04 | 0.50 | 0.64 | 0.44 | 0.69 | 0.05 | 0.46 |
| 1843 | 0.64 | 0.00 | 0.68 | 0.50 | 0.44 | 0.73 | 0.01 | 0.00 |
| 1844 | 0.61 | 0.02 | 0.63 | 0.58 | 0.46 | 0.73 | 0.01 | 0.60 |
| 1845 | 0.64 | 0.00 | 0.60 | 0.61 | 0.47 | 0.73 | 0.00 | 0.04 |
| 1852 | 0.62 | 0.01 | 0.51 | 0.63 | 0.44 | 0.69 | 0.05 | 0.10 |

TABLE 54-continued biomarkers from the 2,040 biomarker library with significance for Wilcoxon P-value (auc.pvalue <= 0.05) and other metrics for the MET event endpoint.

| SEQ ID NO. | auc | auc. pvalue | Sensitivity | Specificity | Pos. Pred. Value | Neg. Pred. Value | KM value | P-Mva HRPval |
|---|---|---|---|---|---|---|---|---|
| 1853 | 0.63 | 0.00 | 0.68 | 0.47 | 0.42 | 0.71 | 0.03 | 0.01 |
| 1858 | 0.61 | 0.01 | 0.65 | 0.58 | 0.47 | 0.74 | 0.00 | 0.06 |
| 1859 | 0.60 | 0.02 | 0.75 | 0.44 | 0.44 | 0.75 | 0.00 | 0.00 |
| 1864 | 0.59 | 0.05 | 0.53 | 0.60 | 0.43 | 0.69 | 0.08 | 0.34 |
| 1866 | 0.62 | 0.01 | 0.54 | 0.68 | 0.49 | 0.72 | 0.00 | 0.06 |
| 1872 | 0.63 | 0.00 | 0.65 | 0.51 | 0.43 | 0.71 | 0.02 | 0.04 |
| 1874 | 0.59 | 0.03 | 0.54 | 0.54 | 0.41 | 0.67 | 0.14 | 0.03 |
| 1877 | 0.59 | 0.04 | 0.51 | 0.67 | 0.47 | 0.71 | 0.01 | 0.08 |
| 1879 | 0.59 | 0.04 | 0.66 | 0.44 | 0.41 | 0.69 | 0.09 | 0.02 |
| 1880 | 0.64 | 0.00 | 0.84 | 0.41 | 0.45 | 0.81 | 0.00 | 0.00 |
| 1882 | 0.60 | 0.03 | 0.62 | 0.53 | 0.43 | 0.71 | 0.03 | 0.29 |
| 1902 | 0.62 | 0.01 | 0.60 | 0.63 | 0.48 | 0.73 | 0.00 | 0.38 |
| 1904 | 0.60 | 0.02 | 0.65 | 0.53 | 0.44 | 0.72 | 0.02 | 0.23 |
| 1907 | 0.59 | 0.04 | 0.71 | 0.45 | 0.42 | 0.73 | 0.03 | 0.22 |
| 1908 | 0.61 | 0.02 | 0.56 | 0.61 | 0.45 | 0.71 | 0.02 | 0.01 |
| 1912 | 0.61 | 0.01 | 0.79 | 0.36 | 0.42 | 0.75 | 0.01 | 0.06 |
| 1915 | 0.63 | 0.00 | 0.63 | 0.52 | 0.43 | 0.71 | 0.03 | 0.00 |
| 1916 | 0.62 | 0.01 | 0.59 | 0.61 | 0.47 | 0.72 | 0.00 | 0.04 |
| 1921 | 0.64 | 0.00 | 0.59 | 0.53 | 0.42 | 0.69 | 0.05 | 0.09 |
| 1922 | 0.60 | 0.02 | 0.65 | 0.54 | 0.45 | 0.73 | 0.00 | 0.13 |
| 1926 | 0.61 | 0.01 | 0.69 | 0.46 | 0.42 | 0.72 | 0.04 | 0.02 |
| 1927 | 0.59 | 0.05 | 0.76 | 0.38 | 0.42 | 0.74 | 0.03 | 0.01 |
| 1930 | 0.59 | 0.04 | 0.29 | 0.55 | 0.27 | 0.58 | 0.02 | 0.90 |
| 1932 | 0.59 | 0.03 | 0.50 | 0.61 | 0.43 | 0.68 | 0.06 | 0.00 |
| 1934 | 0.61 | 0.01 | 0.60 | 0.59 | 0.46 | 0.72 | 0.01 | 0.22 |
| 1936 | 0.63 | 0.00 | 0.66 | 0.53 | 0.45 | 0.73 | 0.01 | 0.02 |
| 1938 | 0.60 | 0.02 | 0.79 | 0.36 | 0.42 | 0.75 | 0.02 | 0.18 |
| 1939 | 0.59 | 0.05 | 0.47 | 0.48 | 0.34 | 0.61 | 0.51 | 0.04 |
| 1941 | 0.61 | 0.02 | 0.69 | 0.44 | 0.42 | 0.71 | 0.04 | 0.04 |
| 1945 | 0.61 | 0.02 | 0.50 | 0.58 | 0.41 | 0.67 | 0.35 | 0.00 |
| 1946 | 0.60 | 0.02 | 0.74 | 0.42 | 0.42 | 0.73 | 0.02 | 0.05 |
| 1948 | 0.60 | 0.02 | 0.65 | 0.50 | 0.43 | 0.71 | 0.02 | 0.03 |
| 1949 | 0.60 | 0.03 | 0.56 | 0.60 | 0.45 | 0.70 | 0.02 | 0.10 |
| 1950 | 0.63 | 0.00 | 0.66 | 0.59 | 0.48 | 0.75 | 0.00 | 0.02 |
| 1953 | 0.62 | 0.01 | 0.72 | 0.42 | 0.42 | 0.72 | 0.03 | 0.01 |
| 1957 | 0.59 | 0.04 | 0.75 | 0.44 | 0.44 | 0.75 | 0.01 | 0.31 |
| 1958 | 0.61 | 0.01 | 0.71 | 0.43 | 0.42 | 0.72 | 0.03 | 0.03 |
| 1959 | 0.61 | 0.02 | 0.72 | 0.46 | 0.43 | 0.74 | 0.01 | 0.02 |
| 1963 | 0.70 | 0.00 | 0.29 | 0.42 | 0.22 | 0.51 | 0.00 | 0.00 |
| 1964 | 0.64 | 0.00 | 0.76 | 0.37 | 0.41 | 0.73 | 0.04 | 0.01 |
| 1965 | 0.67 | 0.00 | 0.54 | 0.66 | 0.48 | 0.72 | 0.00 | 0.02 |
| 1967 | 0.62 | 0.01 | 0.56 | 0.59 | 0.44 | 0.70 | 0.03 | 0.01 |
| 1970 | 0.59 | 0.05 | 0.69 | 0.52 | 0.45 | 0.74 | 0.00 | 0.12 |
| 1971 | 0.60 | 0.02 | 0.59 | 0.56 | 0.43 | 0.70 | 0.03 | 0.01 |
| 1972 | 0.66 | 0.00 | 0.62 | 0.62 | 0.48 | 0.74 | 0.00 | 0.00 |
| 1976 | 0.59 | 0.05 | 0.66 | 0.48 | 0.42 | 0.71 | 0.05 | 0.09 |
| 1977 | 0.59 | 0.05 | 0.54 | 0.57 | 0.42 | 0.68 | 0.11 | 0.11 |
| 1978 | 0.60 | 0.02 | 0.65 | 0.47 | 0.42 | 0.70 | 0.04 | 0.09 |
| 1980 | 0.61 | 0.01 | 0.63 | 0.53 | 0.43 | 0.71 | 0.04 | 0.31 |
| 1981 | 0.59 | 0.04 | 0.60 | 0.55 | 0.44 | 0.71 | 0.03 | 0.58 |
| 1984 | 0.63 | 0.00 | 0.41 | 0.85 | 0.61 | 0.71 | 0.00 | 0.10 |
| 1986 | 0.63 | 0.00 | 0.69 | 0.49 | 0.44 | 0.73 | 0.01 | 0.06 |
| 1988 | 0.60 | 0.03 | 0.72 | 0.46 | 0.43 | 0.74 | 0.01 | 0.00 |
| 1990 | 0.62 | 0.01 | 0.56 | 0.62 | 0.46 | 0.71 | 0.01 | 0.01 |
| 1991 | 0.59 | 0.05 | 0.59 | 0.54 | 0.43 | 0.70 | 0.06 | 0.64 |
| 1992 | 0.64 | 0.00 | 0.74 | 0.45 | 0.43 | 0.75 | 0.01 | 0.01 |
| 1994 | 0.59 | 0.03 | 0.56 | 0.55 | 0.42 | 0.68 | 0.12 | 0.31 |
| 1998 | 0.66 | 0.00 | 0.60 | 0.60 | 0.47 | 0.72 | 0.00 | 0.00 |
| 1999 | 0.60 | 0.02 | 0.66 | 0.46 | 0.41 | 0.70 | 0.05 | 0.00 |
| 2004 | 0.60 | 0.02 | 0.71 | 0.43 | 0.42 | 0.72 | 0.05 | 0.02 |
| 2005 | 0.67 | 0.00 | 0.63 | 0.65 | 0.51 | 0.75 | 0.00 | 0.01 |
| 2007 | 0.62 | 0.01 | 0.54 | 0.62 | 0.45 | 0.70 | 0.01 | 0.02 |
| 2009 | 0.60 | 0.02 | 0.60 | 0.53 | 0.42 | 0.70 | 0.04 | 0.00 |
| 2012 | 0.61 | 0.02 | 0.71 | 0.45 | 0.42 | 0.73 | 0.02 | 0.01 |
| 2013 | 0.59 | 0.04 | 0.53 | 0.61 | 0.44 | 0.69 | 0.03 | 0.09 |
| 2014 | 0.59 | 0.04 | 0.59 | 0.47 | 0.39 | 0.67 | 0.36 | 0.21 |
| 2016 | 0.60 | 0.02 | 0.68 | 0.42 | 0.40 | 0.69 | 0.13 | 0.28 |
| 2018 | 0.59 | 0.04 | 0.63 | 0.50 | 0.42 | 0.70 | 0.05 | 0.44 |
| 2019 | 0.65 | 0.00 | 0.71 | 0.52 | 0.46 | 0.75 | 0.00 | 0.01 |
| 2023 | 0.61 | 0.02 | 0.57 | 0.59 | 0.45 | 0.71 | 0.01 | 0.00 |
| 2024 | 0.59 | 0.04 | 0.65 | 0.50 | 0.43 | 0.71 | 0.06 | 0.07 |
| 2025 | 0.59 | 0.03 | 0.69 | 0.48 | 0.44 | 0.73 | 0.01 | 0.03 |
| 2027 | 0.61 | 0.01 | 0.68 | 0.53 | 0.45 | 0.74 | 0.00 | 0.00 |
| 2030 | 0.61 | 0.01 | 0.66 | 0.47 | 0.42 | 0.71 | 0.04 | 0.01 |
| 2032 | 0.59 | 0.05 | 0.59 | 0.57 | 0.44 | 0.71 | 0.02 | 0.05 |
| 2033 | 0.63 | 0.00 | 0.66 | 0.55 | 0.46 | 0.74 | 0.00 | 0.68 |
| 2034 | 0.60 | 0.03 | 0.41 | 0.70 | 0.44 | 0.67 | 0.11 | 0.10 |
| 2036 | 0.62 | 0.01 | 0.68 | 0.47 | 0.42 | 0.71 | 0.04 | 0.17 |
| 2037 | 0.59 | 0.03 | 0.59 | 0.48 | 0.40 | 0.67 | 0.30 | 0.38 |
| 2039 | 0.64 | 0.00 | 0.69 | 0.57 | 0.48 | 0.76 | 0.00 | 0.00 |
| 2042 | 0.59 | 0.05 | 0.78 | 0.35 | 0.41 | 0.73 | 0.04 | 0.59 |
| 2043 | 0.63 | 0.00 | 0.56 | 0.65 | 0.48 | 0.72 | 0.01 | 0.01 |
| 2044 | 0.63 | 0.00 | 0.63 | 0.49 | 0.42 | 0.70 | 0.08 | 0.01 |
| 2046 | 0.61 | 0.01 | 0.66 | 0.53 | 0.45 | 0.73 | 0.01 | 0.06 |
| 2048 | 0.62 | 0.01 | 0.69 | 0.51 | 0.45 | 0.74 | 0.01 | 0.96 |
| 2050 | 0.59 | 0.05 | 0.57 | 0.61 | 0.46 | 0.71 | 0.01 | 0.01 |
| 2052 | 0.64 | 0.00 | 0.76 | 0.46 | 0.45 | 0.77 | 0.00 | 0.01 |
| 2054 | 0.61 | 0.01 | 0.74 | 0.47 | 0.45 | 0.76 | 0.00 | 0.05 |
| 2056 | 0.62 | 0.01 | 0.71 | 0.48 | 0.44 | 0.74 | 0.00 | 0.01 |
| 2058 | 0.63 | 0.00 | 0.72 | 0.46 | 0.43 | 0.74 | 0.01 | 0.02 |
| 2060 | 0.62 | 0.00 | 0.74 | 0.47 | 0.44 | 0.75 | 0.00 | 0.00 |
| 2061 | 0.62 | 0.01 | 0.72 | 0.48 | 0.45 | 0.75 | 0.00 | 0.06 |
| 2062 | 0.59 | 0.04 | 0.82 | 0.31 | 0.41 | 0.76 | 0.04 | 0.42 |
| 2063 | 0.61 | 0.01 | 0.63 | 0.50 | 0.42 | 0.70 | 0.06 | 0.09 |
| 2064 | 0.62 | 0.00 | 0.63 | 0.57 | 0.46 | 0.73 | 0.00 | 0.01 |
| 2067 | 0.62 | 0.01 | 0.62 | 0.55 | 0.44 | 0.71 | 0.02 | 0.09 |
| 2068 | 0.60 | 0.02 | 0.53 | 0.58 | 0.42 | 0.68 | 0.07 | 0.11 |
| 2069 | 0.62 | 0.01 | 0.85 | 0.28 | 0.41 | 0.77 | 0.02 | 0.08 |
| 2070 | 0.66 | 0.00 | 0.54 | 0.64 | 0.46 | 0.71 | 0.02 | 0.10 |
| 2071 | 0.65 | 0.00 | 0.69 | 0.54 | 0.47 | 0.75 | 0.00 | 0.01 |
| 2072 | 0.59 | 0.04 | 0.74 | 0.38 | 0.41 | 0.71 | 0.07 | 0.06 |
| 2073 | 0.63 | 0.00 | 0.50 | 0.61 | 0.43 | 0.68 | 0.12 | 0.01 |
| 2074 | 0.60 | 0.02 | 0.66 | 0.47 | 0.42 | 0.71 | 0.06 | 0.29 |
| 2076 | 0.62 | 0.01 | 0.75 | 0.46 | 0.44 | 0.76 | 0.00 | 0.12 |
| 2080 | 0.60 | 0.03 | 0.75 | 0.42 | 0.43 | 0.75 | 0.01 | 0.01 |
| 2081 | 0.60 | 0.02 | 0.72 | 0.43 | 0.42 | 0.73 | 0.02 | 0.01 |
| 2082 | 0.61 | 0.01 | 0.72 | 0.38 | 0.40 | 0.70 | 0.12 | 0.24 |

Auc.pvalue: Wilcoxon Test P-value.
KM: Kaplan Meier curves.
mvaHRPval: Multivariable Analysis Hazard Ratio P-value.

TABLE 11

List of Target Sequences

| SEQ ID NO: | SEQUENCE |
|---|---|
| SEQ ID NO: 1 | ATACCCTTCGCCATGTTATCAGCCAGACAGGAGGATAC AGTGATGGACTCGCAGCCAGTCAGATGTACAGTCCGCA |
| SEQ ID NO: 2 | GGGCATCATCCCTGGTCCAAAATCAAGATACCGAATTA GAGTTGAGGGTAAAAAACACATCTTGATCATAGAGGGA GCAACAAAGGCTGATGCTGCAGAATATTCAGTAATGAC AACAGGAGGACAATCATCTGCTAAACTTAGTG |
| SEQ ID NO: 3 | GCAAAGGTTTCAGCGTAGTGGCAGACACGCCCGAGCTC CAGAGAATCAA |
| SEQ ID NO: 4 | CAGCTGGTGTGCCTTAAGAGAATCCCTATAAATAACAG AAAAGACACTCCAAGCATTCCTGTACGTGGACTCAGAG CACAGAGAAAGAAACTAAAATGCCTTTTGGCATTTCA AGATATTTGGCACTCTTGTGATTACATTTTTTTTACAGT CCATTAAAGAGAATAAACTGACATAATATTAGAGAAAT AAACAGGCTGCTCACACAACAGACTGCAAGGGGAAGTT AGAAAAAGCTCAAGCATTTTTTTCTTTGTTTTTCGTGT GTGTGTGTGTGTGTGTGTGTGTGTGTTTTTCT GACATAAAAAATGTGTCCATTTGCATTAACTTGGGCAG ATAGCTTGCAGCAACAAAGAAACACAAGCTTTACAACT CATTTTAAAATAAAATCTTTTCTATGTATCATTCCTTA GAAAGTTCTCTTCTTGTTTTAAACACATTCCTGATAA CTTCTAAAGATGACCAAAATAAAACAGAATATCTACAG AGATCATTTCTGAATTTTTTGTACATCCAAGGATAAC AACATAAAAAAAATAAAACTGGACAGCATTTCACATCC |

TABLE 11-continued

List of Target Sequences

| SEQ ID NO: | SEQUENCE |
|---|---|
| | AAGTGCACAGAACCATTTTTGCAAGATTAAATAATGTA AACATTGGGAACAGCCAAATCAGCGAAGAATGCCAACA CCTCAAAACACCTGGTGTTGCCGCTTCATTAAGTGGTT CAAAATCCAGATCTATAATTGCGCAATATTCACCGTAT ATAAAAAGAAATGGATATTAATTTTGACAAATAGCTGC AACTGAGACTTCTTTTTATTTCTTTATATGTGTATATA GTGAATTTTTATTATTTTTAAAATTTTATTTATTTTTT TATTTTTATTTTTGCAGAGGAGCCCAGAGCCTTCTCCT CCTCCTCCTCCTCTCGCCTCATCTGTCTCCCGGCC TGATACCAGATACAGGTTGTTGATTTCATCGTGGGTAG CAAGCTAGTAATAAATTTCAAAGTGCTTTCTCTTTTCA TGCTTTTTGCCAATAACTGTTACCGCCGTTCTTATTCT CTCCCTTAACTCATTGTCTTTGGGGGAGTTAGACACCA GGAGGTGCCTTGTCGGTCATATTTTTCAGCACGTCATC CTCCTGTGTCCTTAAAGTAGTCATGGGCTGGGAATGTT |
| SEQ ID NO: 5 | CGGTTAATATCCCGGGTGATAGCACTGCTCTGGGGAGA CTCCTGTGGAAACATAAGGAAAGAGAGGGTTTAGTTAG GTTAATCATGTAAACTCTTATTCAGGTTTAGGCAAGGT CTTCTCATTTACACACTTTAAATGTTGCAGGGACATAC ATACACATATGTATGCCCATAGTTACTGCCTCTTCAGG |
| SEQ ID NO: 6 | TATACAAGGGCTCAACCGAGGCTTAATTTAAAAGACAA AAACAAAACAAAAATACCACAGCTCAAGATAAAGAGTC CTATACAGAAATCACAAAAAGGACAGACCATCTAAGGA AAAATTAAAAAGACGACACAAGGACAGGCTGGGCAGCC TGGGTCAGGGCTCCTGGCTGGTGACCTGCTTTGAGTAG GTTTCTTGCAGGTACTTCTTAAAAGC |
| SEQ ID NO: 7 | GCTGAGGCACCAATCATACCCTATACAGACAGCTAAGC ACATTGTGTAAGGCAGATGTTGCCCACCACTCAGCCCA TTAGAGAGCTCATGCACCATCAAACCCAGAATAAAGCA ATAAGCCCAATGGTGATCCAACCCTTTG |
| SEQ ID NO: 8 | TCAGGCTTCTGTTGCAAGCCAATGTAGGGAACCA |
| SEQ ID NO: 9 | GCTTTCATACTTGGAGCTCTACTGATTTTCCATCCAAG CCAACTTGTAGGGTTTTTTCCTTCCTATCACCAGAGGA GACAGGGTTTAGGGGAATCCAAGAAGGTTGAAGTCAGC ACT |
| SEQ ID NO: 10 | GGGTTATCTTCTAGTCCACATGTCACATAATATGTACC TTTATTTACCTTTTAAACTGAAGTTTTAAAACCTGGGT TTTAAAAAGAGAACAACTACCCATCAGCAATTACAGAA GACAAAGGAACTTGTGTGTCTGAAGACTGAGTGTTATT TAGCAGCTCTTTGGTCAGCTTGGATTGGTCACATATGT GGAAACTGGGAAATAATAGGGGCTACTTACACTGGAGA AGAACACTACAAATGGTGTAAAGAGTGGTTTTGGAATG TATCCAGACTTCCTTCTAAAATAAAAATTTAAACAGCT GTGTTTGAGAGATGGGATGCACAATTCTTGTAAGAAA GACTGTGTAGATGTTTGAGGTCCCCTTAGTCCCTGATG CTACCATTGTTCC |
| SEQ ID NO: 11 | GGGCAAAATATTCCTGGAGTGCTGAGCAATACATGTCA CAGTCTCCAATTTTTTTTTTATTCTTACGTTAGTTCAG ATTCCACTGTATCCAATATGTGCTTGAGAGTGAAAATT GTATTAGTTTCTATTGTAATCTATCTCCATTTCGCCTC GAGAAAAATTA |
| SEQ ID NO: 12 | TGTCGAGGCCCGGTTGGCTTTCAGAGGCGTATCCATGG GAGTAGGTGTCATGTATCAAATAGGAGATTCAAAGTCA GCTGTTACCACGGCTACAGAAATGCCAGTCTTTTCCTA AGAGTGCGAA |
| SEQ ID NO: 13 | CCGGGTATCAGATGGTTATTATCCGACC |
| SEQ ID NO: 14 | GTTGCAACTATCTATGCTGCCTGTAGCAGACACACTCC AGCTCTAAGGATACATATAGAATGAAAGTAAAGGGATG AAAAGAAGATGCTCCATGCAAATGGAAAACAAAAGACG GTAGGGGTGGCTATACTTACATCAGGCAAAATAGACTT TTAGTCAAAAATTATAACAAGAGACAAAGGAGCTCACT ATATAATTATAAAGGGCTAATTCATCAAGAGGATATAA AAATTATAAGTACATATGCACATAATGTCAGAGCACCT AAATATAATATTTACATAACTGGAAGGGAGAAACAGC AATATAATAATCGTAGCGGACTTCAGTA |
| SEQ ID NO: 15 | CCTTGACCTGGGAAAGCCATTACTCTTGTGTCTGCTAC TGCCCTCCCACAGTCACCCCAATATTACAAGCACTGCC CCAGCGGCTTGATTTCCCCTCTGCCTTCCTTCTCTCTA CACTCCCACAAAGCCAGGGCCAGGCTCCCCATCCCTAC CTCCCACTGCATCAGCAGTGGGTGTTCCTGCCCTTCCT GAGTCTAGGCAGCTCTGCTGCTGTGATCTGCACACCCT CCAACCTGGGCAGGGACTGGGGGGATGCAGTGTGTGTT AGTGCCCATGTGGCATTGTGGCACTGTTGCCCCCCATG GCGGCATGGGCAAGATGACCTTCCATTAGCTTCAAGTC TTGTTCTCTTGTCTGTGGTCTGTTTAATATGTGGGTCA CTAGGGTATTTATTCTTTCTCCCATCCTTACACTCTGG ATCATTGTGCAGACTTAATCAGGGTTTTAACGCTTTCA TTTTTTTTTTTTTTTTTTTTTTTGAGCTCAAAGAGA GTTCTCATTTTCCCTATTCAAACTAATACCCATGCCGT GTTTTTACCTTGGATTTAAAGTCACCTTAGGTTGGGG CAACAGATTCTCACTCATGTTTA |
| SEQ ID NO: 15 | TTCGAATGTTTCAGAGCGCAGGGCCGTTCTCCCTCGTG TCCTCTGGACCCACCCGCCCCTTCCTGCCCTGTTTGCG CAGGGACATCACCCACATGCCCCAGCTCTCGGACCCTG CAGCTCTGTGTCCCAGGCCACAGCAAAGGTCTGTTGAA CCCCTCCCTCCCATTCCCAGTTATCTGGGTCCTCTGGAT TCTTCTGTTTCTTGAATCAGGCTCTGCTTTCCCCCTAG CCACTACAGGCAGCCTCTGACAGTGCCGCTTACTTGC ATTCTGCAGCAATTACATGTGTCCTTTTGATCCTTTGCC CAACTTCCCTCCCTCTCCCAGCTCCTGGCCCTGGCCC AGGGGCCCCTCTTGCTGTTTTTACCTCTGTTCCTTGGG CCTAGTACCCAGCAAGCACCCAAATGGGGAGGTTTTG GGATGAGAGGAGGAACGTGTATACCTGATAACATCTGG TGGCTCTTCCCCCAGAAGTTTGTGTTCATACATAATTG TTTTCCACGCTGGATCATAATGTGACGTGCAGTTCTGC CCTGTGCTGGGGAGCCACATGAAGCTTCCCCTGGCTAA CTTGCTACCCCGCAGCAATCCCAGTGTGGCCGTCTGCT TGCTAAAAAATG |
| SEQ ID NO: 17 | TCACGATGAAGCATGCTAGAAGCTGTAACAGAATACAT AGAGAATAATGAGGAGTTTATGATGGAACCTTAAATAT ATAATGTTGCCAGCGATTTTAGTTCAATATTTGTTACT GTTATCTATCTGCTGTATATGGAATTCTTTTAATTCAA ACGCTGAAAAGAATCAGCATTTAGTCTTGCCAGGCACA CCCAATAATCAGTCATGTGTAATATGCACAAGTTTGTT TTTGTTTTTGTTTTTTTTGTTGGTTGGTTTGTTTTTTT GCTTTAAGTTGCATGATCTTTCTGCAGGAAATAGTCAC TCATCCCACTCCACATAAGGGGTTTAGTAAGAGAAGTC TGTCTGTCTGATGATGGATAGGGGGCAAATCTTTTTCC CCTTTCTGTTAATAGTCATCACATTTCTATGCCAAACA GGAACAATCCATAACTTTTGTCTTAATGTACACATTGC ATTTTGATAAAATTAATTTTGTTGTTTCCTTTGAGGTT GATCGTTGTGTTGTTGTTTTGCTGCACTTTTTACTTTT TTGCGTGTGGAGCTGTATTCCCGAGACCAACG |
| SEQ ID NO: 18 | GTCCATCGAGGTGTTTCATAAGTTTTTTGGTGTGTTTT CTGGGTCGTCTATGTGTCATATGGTTTTACTTTTCTCT CCTTTTTCGTTTTCAGAACATTTTTCTGTCTGTTTTGG ATTCACTGCTTCCATTTTACAGAATGTCACTCTTTAGA CTCTCAGTCCATCATGCCATCGGGTACTCTTGTTGCAG TGTAATTTTTATTCATGCGGTTATTTCCCTAACGATG TGCTATTCACGTTCATCTTCAAACTCATTTTCCATCAG CCAGTGTCTACTATTTAGTGCCCTGGCTCTATTTCGGT CCTCCTCCCCGGGCTTTCCCTGGCTGCTGTGCTGGCA AAAGCATGGGCTTTATTCTCTCCATTGGTGCTGCTCC ACCTTAGAGGTGTGACCTCACTAGCGTTGACTG |
| SEQ ID NO: 19 | CCCACTTTAGTCACGAGATCTTTTTCTGCTAACTGTTC ATAGTCTGTGAGTTGTCCATGGGTTCTTCATGTGCTAT GATCTCTGAAAAGACGTTATCACCTTAAAGCTCAAATT CTTTGGGATGGTTTTTACTTAAGTCCATTAACAATTCA GGTTTCTAACGAGACCCATCCTAAAATTCTGTTTCTAG ATTTTTAATGTCAAGTTCCCAAGTTCCCCCTGCTGGTT CTAATATTAACAGAACTGCAGTCTTCTGCTAGCCAATA GCATTTACCTGATGGCAGCTAGTTATGCAAGCTTCAGG AGAATTTGAACAATAACAAGAATAGGGTAAGCTGGGAT AGAAAGGCCACCTCTTCACTCTCTATAGAATATAGTAA CCTTTATGAAGCAGGAACAGTGTATACCTGGATACAATG CAATATTTTACCTAGGTGAAATTGTTTAGGCTTATGTA CCTTCGTTCAAATA |
| SEQ ID NO: 20 | ATTAGCAGCCATATTCCACAGTTCCTATAATTTTTACT GGGGGGATTTGTGATAGGAAAGTCCTTGGGAAACATT TCCAATCTTTCAAAATATTATTGTGTATCTTAAGGAAGT ATAGGAACTTGTATGTTGAAATGTTGTATGGTAGTTCT TGTATAGTTAAATAATAATCTTTTTAAGAGTTAATGAT AAGCATATGTTATGTGCATTATTAATAAAAATAGTGGC ACTTAGGTAATACCCACTTTTATCTTGTGTGCTGGGTA CTCTGGTTACTGAGATAAATAAGGCACTGGACATCCTC ACGTGGAGTTCACAGGCTCATCAGTGAATTCTGTACCA CATTTCAACCTTGTTTATTTTAGTTTAATGGAATATAC ATTCTTAGTATTGCCTGATTATTTAAATTTGTTGAGGG |

TABLE 11-continued

List of Target Sequences

| SEQ ID NO: | SEQUENCE |
|---|---|
| | GGATTGCATGTTGCTTTATTGGCCTGTAAAAATAGCTAGTTTGGTAAGATTTGGTCTCGCACCTTCCATCTTTGCTACCACATTAAAGATGAGCTTGTTAAAAAGGAAAGCATATTTCTCTGATTGCCCTTATGGAGAAATA |
| SEQ ID NO: 21 | GGCTTCTGACGCCAAATGGGCTTCCCATGGTCACCCTGGACAAGGAGGCAACCACCCCACCTCCCCGTAGGAGCAGAGAGCACCCTGGTGTGGGGGCGAGTGGGTTCCCCACAACCCCGCTTCTGTGTGATTCTGGGGAAGTCCCGGCCCCTCTCTGGGCCTCAGTAGGGCTCCCAGGCTGCAAGGGGTGGACTGTGGGATGCATGCCCTGGCAACATTGAAGTTCGATCATGG |
| SEQ ID NO: 22 | GTGATTTCTGTATAGGACTCTTTATCTTGAGCTGTG |
| SEQ ID NO: 23 | AGAGGATGTCCATGTTCAATCACCACTGTCCAAATTCA |
| SEQ ID NO: 24 | GAAGCTCAGAACGCTGGACTCTCCCTTTGCAG |
| SEQ ID NO: 25 | AGAACTAGCATGTCTTCGTGGCCATGCAAGGGCAATATATGGAGTGCAGAAAAAGGCGGAAACTCAAAAAGACCACCCAGGAAACCATCGACAAGACTGCTAACCAG |
| SEQ ID NO: 26 | GTGTCTTGCTTCATCCCACTGACTGCTGGGAGAGAGCCTCTGGGACTTTTCTTTGGGGCATCATTTTGTTTTGTCTTTCGTAGCAGGGAAAGGATATGACAATGGGGAGGACAGTTCTTTTGGAGGTTGGAGGGGCCAAGCCAAGGACAGGAGCAAGTGTGCCCTCATTTTGTTTC |
| SEQ ID NO: 27 | CGTTTACGGCTTCCACTTGAGTATATGGCAATCTGTGCCCTTTGTGCAAAAGATCCTGTAAAGGAGAGAAGAGCTCATGCTAGGCAATGTTTGGTGAAAAATATAAATGTAAGGCGGGAGTATCTGAAGC |
| SEQ ID NO: 28 | AACAAGATGAACAAGTCGGACTTCCTGGGAAAGGGGGAAGGCCAAGGGGAAAAAAACACAAATGGCTGAAGTTTTGCTTCTCCGCGTGGTCAAAGAGTCATTCCACGAATAACCATAGAAATGAA |
| SEQ ID NO: 29 | GTCCCAGGCGGTCTAGCAGTGATGAGCAGGGCCTCTCGTATTCATCTT |
| SEQ ID NO: 30 | AAGAGATACTCAGAGATGGATGATCATTATGAGTGCTTGAATAGATTGTCTCTTGAC |
| SEQ ID NO: 31 | AGCCAATCTTGGCTCGGATTCAGGAGGACCGCACTGTGATTGTGTCTCCTGTGTTTGACAACATTCGTTTTGACACCTTCAAACTGGATAAGTATGAACTGGCAGTTGATGGGTTAACTGGGAACTCTGGTGCCGCTACGATGCACTGCCACAAG |
| SEQ ID NO: 32 | ATTAATTAAAGTTCTGATTCAGAGGGGATATGATTCGGATCCTGTGAAGGC |
| SEQ ID NO: 33 | AAACGCTGGCGTCCGTTTCTGCTGAGAGCGTGGGCTTTCTCTGCAAGTGGGGGTGGGAGGTAGGGTTTGGATGAGGGTGTGGGAGGACCCTAAACTGATTCCCATGCTAGTTGGAGAAAGAAAGGTGTGGATGAGGATAAAGTTTTCATGGTGACCAGGGTGACCCTCCGCTCAGAGGGACGAGCGG |

TABLE 11-continued

List of Target Sequences

| SEQ ID NO: | SEQUENCE |
|---|---|
| | AGCCCGGCAAAACCAGTCACTGCCTTGTAGTTCCAAGCTTTGGGGATGATCAGCTCCCAAGAAATTGCTGTGGGGTGCGGGGCTGTGGGTGACCCAAATTGGGCAGAGGGCCTACAGGTCTGAGGCTGCCTGCACA |
| SEQ ID NO: 34 | CATTTCTCTCTGGTGTGGCGAGCCGAGCAGATCGCTGGGAGAGAAATCGGAAAAGGGGGAGAGGAAAAGGAAAAGGGGACTTGGAGAGAGACTTTGTGCTTCAATGTTTC |
| SEQ ID NO: 35 | TTTGAGTCAGGTTATCTCTGTCGCTCAAGCT |
| SEQ ID NO: 36 | ACATTTGTCTGCTTGGGCTGTCATAACAAAATACCATCGACTAGTGTAAAATAAAAATCTATTATCTCTCAGTTCTGGATGCTAGAAGTCCCAGAGTAAGGTGTCCATATATTTAGTTTCTGGCGAAGGCTCTTCCTGGCTTGTAGTCAGTGCCTTCTCTGTCTGCCCTCACTTGGCCTATCCACCTGTGAACACAAATAAATATCTCTGTTGTTTTTTCCTCTCCTTATGTGAACATGTGTCCTATGGAATTAGGGCCTCACTCTTGTGACTTCA |
| SEQ ID NO: 37 | AGTGAGACATTGTGGCCTGGAAGTCTTTCAGACACCCACTCAGAGAAGTCAAGTTTAAAGTGGATGTTCTTCAGAGAATTTTTCATTTCTGAAAATGTGTTTTGCTTATGAATATAACAGAGTTGACTAGAAAGAGAGAAACAACTGCATACTAATCTTTTAAAGCCTTTAACAGTTGCTTTTAAACTTTCTTTTTAAATGTTTCATGACTCTTCACCTATTTTTTTTAAATGGGGACGAAGAGATATGAAAACTGAAGCATAAGACAAATACCTAGAAACCTCTAAGACTGCACATATGATTTGGTAGAAGTCTGAAGGTATACACATTGTAAGAGGCAGACCTA |
| SEQ ID NO: 38 | CAGGGTGCTAATCATGATATTTGGTTACA |
| SEQ ID NO: 39 | CTGGCCCTGTGATATAACACAGATCAGCAATGGATTCACAATACTCTCTGGCTATGTGACAACAAGATGCAGGTCACCCAGCAACTCGACACTTCCTCAGACCACTACAGGTCAAAGTCAATTCCTGATCCAACTAGAAATGTCACGAACATGCCTTTCAGATG |
| SEQ ID NO: 40 | GATGAGACTAGGCAGGGTGACAAGGTGGGCTGACCGGGAGTAGGAGCAGTTTTAGGGTGGCAGGCGGAAAGGGGGCAAGAAAAAGCGGAGTTAACCCTTACTAAGCATTTACCCTGGGCTTC |
| SEQ ID NO: 41 | TTCCTTTTTATGTCAACGACGCCCATAG |
| SEQ ID NO: 42 | ATGAGGACAGGCCTTGAGTCTGTCCTGGTCTCTGGAATCACGGTGTCTAGTAGAGGCCAGCACACAGCAAATATATAAATGTACAAATGAGTGAATGAAGAGAATCTGATTGGCCTTAAGGAACTTACGCACTTAAATAATTGGGCAGAAGAGAACAGTCAAGGAGTGCAGAGGCATCACCTGA |
| SEQ ID NO: 43 | AGCACAATGGCTGGAGGTCAGATGCCCACTAGGAGATGCT |

TABLE 55

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 313 | 2315652 | 1 | | AATGGCAAAGGACCACGGTGCCCTGCCCAGCCGCCTGCTGCAGGGAGAGCAGCTCCCTCAGACCCGGAGTGCTCTGCTGT | 0.013881148 | 0.009628618 | 4.57E-06 |
| 1865 | 2318066 | 1 | | ATCAGAAGATTTCCGGGAATGGCCCTGGCCAAAACCAATGTTGACCAAACCA | 0.000124059 | 0.007038957 | 3.54E-06 |
| 851 | 2318095 | 2 | KCNAB2 | TGAGTGAGCAGCCTGCGGCAGCCCTGACTCACTGCGGGTCGTGCCGTCTGTGCAGCACTGGGGTACCCCACCACCC | 0.017721275 | 0.008633649 | 5.18E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 375 | 2320530 | 3 | NPPA-AS1 | GTGAAGACCCGTGGCCAGCTTCTGTTGT TGCCATCGGCCATTGCTTTTTGTTCGCTT GCTTTTGGTTTTGCAAGAAGAGCGGCCT CTGTCTCTGATCTGCTTCAAATCATCATT CCATCAGTGACAGAAGTGGCTGTTCCAT CAGTGGTCGCAGCCAGTTC | 0.017194217 | 0.009820199 | 7.40E-06 |
| 1289 | 2321544 | 4 | KAZN | ATTCCTTCCTCCAGTGTGACCATCACACA TTGTCCATATGGCTGGATGTGAG | 0.015428709 | 0.007819131 | 3.23E-06 |
| 1326 | 2324753 | 9 | ZBTB40 | GTAAGGGATGTCTCTGCGCCATCCTCAG | 0.0060277 | 0.007357121 | 4.99E-06 |
| 2077 | 2324895 | 2 | C1QB | GCTGCTTCACATCCACCCCGGCTCCCCCT GCCAGCAACGCTCACTCTACCCCCAACA CCACCCCTTGCCCAACCAATGCACACAG TAGGGCTTGGTGAATGCTGCTGAGT | 0.001253978 | 0.006841561 | 3.40E-06 |
| 418 | 2326211 | 5 | STMN1 | CCACCTGTAACGTAGAGCAAGCAAACCA CCAAGTAGAATCTTGAGATTCTCTCA ACTGTTCTCTAGAAACACGCTTGTGCTTT TAATCTGCCTTTTAAAAGGGACACAGAA CAAAAAATGGTTGTTTGCAAATAAACAT CTGAAAGAAAGTAACAGCTGACCTGGGC TGAGGCATCCAAACAAAGCAGTCATTGT GGAAGGAGACAATGCAAACCACACTGG GGCAAGAAACGGGGCAGAGAACGTGCG GTCATTTGTGCGTTGGGTATTTCTACCAG CCCCAAAGGCCCCATCTGGAACAAGTAT CAACCAGGAGGGGCTCTATGGCTTGATT TATTAACCTAACTCAAAAGAAGTCACTG CCACCAACAGCACTGTGCAGTTTTATTA ACCATTCAAGTCCAGTAGCATCTGGTAA GATTGGGACAGAATTGGGATTGAAAAGT GAACAGATATTCAGCATCTAACAGTTCA AAAGAAGCCACTACATACTCTTTTCACA AATATGTTTTCACAGAGCCAATACAGTA CTAGCCATTAACCCAGTACACCAAGTGT ACTGAAGTAGAAAAGATGCAACAAGAA AAATAGCTACATTAGAAAGACCAACACT TTAGAAAAAGAGTAAAACACTTTCAGTT TCTCCCCTTTAGCCCCTAAAACAACATCT TACAGTCTGGATCTGGATCTACCTATAC AGTCCTACATTAGCTTCTAAAATATTTGT CAGGAGGGAAAAAATAAAATGACACTG GCCAGTACAGTCTTTGGATATTTAGGAA GGGGATGGGGAGAAAGTCAGTTCTCAGA ACAAATTAGTCAGCTTCAGTCTCGTCAG CAGGGTCTTT | 7.48E-05 | 0.021492165 | 1.52E-05 |
| 1954 | 2326780 | 2 | SFN | TGCGCGCGCGCCAGTGCAAGACCGAGAT TGAGGGAAAGCATGTCTGCTG | 0.000243178 | 0.00786279 | 3.51E-06 |
| 1304 | 2327444 | 4 | PHACTR4 | ACCGGGAAGGCATCGAATTTGCTGCGAT GTCTGTGCAGCTCACATCTGTGATCGGT GGACCAAAGAACCAGT | 0.002984774 | 0.006653744 | 2.06E-06 |
| 1385 | 2329291 | 4 | ZNF362 | ACCTCTGCCAGATTGTGCCTATACAACG TGTAATGTGGCGGTTACCCTTTTTTGGA GAATCTTCGTTTGTCAGTGTTTCTGAACA AGCAGAGATTGATGTCTTTTTATAACCTT AAAGGCTGAAATTCCACAAGCCATAAGC AGGTCCAGTCCGGTTTCCTGGAGGCCCG GGGAGGCCTCATTCCCACTTTTGAAGTG CAGTCCTTGTTTCTTACTCTCAGGCTTGT CATGCCTAATTAAATGAAATTTGTCTTTA ACTGTGACATTTCTGGCACAGCCATGGT TACAAATTTGATTTACCCAATTATATCCT GTTAGGAAGGAGGACAGATTCTTACAGA TCCTGTTTACAGAACTAATGATCGTAAA AGAAAAGGGTCTCAGCAAAGGTACTTTG AAGAGTTTTTAGCTATTATTCCTAGTAGT TTTGTAGATAAGGCCAATTACATTTGTTG TTTTCAATAGAATGATTATTTGAACATTT CCTTGATGATTTATTATTTCATATCTATG TTAGGTTTTTATAGTCCCCCTCCCACCCT CACCCCCAGAATTCTGAAGAGTTAGTTG GAAGAAGGAAGAAGGCACCATTTTAGG | 0.012844897 | 0.007545796 | 4.23E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 135 | 2329991 | 5 | CLSPN | AATATTTTATTCCAGTTTATTGAATACAG CCTCCTAAATTGAGGATTAGCGACAGTA ATAAAGAAAAAAAAAGACCTTTAGAAA ATTAGAACATTAAGGGTGAAATCAGTTT CATCCAGTCCTGGGGAAAAATTCCTGTT CCTCTGATCCTGGGTTAGTTAGCCTGC CCCATCTGTTGGTTCCTAGGTCCTCCATC TAAGAAATCGTTCTTTTGGCTGGGCACA GTGGCTCACGCCTGTAATCTCAGCACTTT GGGAGGCTGAGGCAGCTGGATCACTTGA GGTCAGGAGATCGAGACCAGCCTGGCCA ACATGGTGACTCCCTGTCTCCACTAAAA ATACAAAAATTAGCCAGGTGTGGTGGCA TGCACCTGTAGTCCCAGCTACTTGGGAG GCTGAGACAGGAGAATCACTTGAACCCG GGAGGCAGAGGTTGCCGTGAGCCGAGAT TGCGCCACTGCACTCCAGACTGGGCAAC AAAGTGAGACTATCTCAAAAAAAAAA AAGAAATCTTTCTTTCACCGAGCCCTGGT CATCATGGTACGTATCTCATGGGTGTAA AGGAGTCATTA | 0.001302035 | 0.022069922 | 1.50E-05 |
| 143 | 2329993 | 3 | RP11-435D7.3 | TACTTCATCAATTACGTCCTCTTCATATT CATCAATTTCTTCCCCATCATACTCATCT TCGCTTCCCACATCACTTC | 9.91E-07 | 0.026064562 | 2.95E-05 |
| 56 | 2329994 | 3 | RP11-435D7.3 | CCAGTGCCAGATCATTACCAGAGTCACT GTGTTCATCCTACAAAATCAGCATCATA TCCAAATTAAGCAGAATAAAATGCGTCC TCAATGAAAAAAGGATTTATAAACATCT GCCCAAATACCTCATTCTAGGAAATTGT TTCTGATAAGATGCCAAACTTAGAATTC TCAAGAACTGAGGGGAAAAAAACACTT GAGGGCAGCAATACATGGAGCTCAGTTA TGATTACTTTGTTCCCTTCATACTCACCT CATCACTATCAAACTCATTATCATTTGAA ACAAGCCGAAAGTCTC | 4.78E-07 | 0.046754573 | 5.18E-05 |
| 1342 | 2330255 | 4 | ADPRHL2 | CCAGTGCGATCTCCGGCCTTATAGACGT CTCGCCCCGAACATCCCGTGCTCGGGGC GTGGCAGCACCGGGGCCTCAACCGTGCA GGGTGTGGATAAACCCATCGTAAGTTGA AAATACCTGAAGTGGAAAGTGCGCTTTC AGCTTAGACGACCGTTTTATCTGGACGC AGCCCCATCGGACGTCGAGGAGCCTATG AATGCGTATCAGCGTTATCAGAAAGCCG AAAAAAACTTAAGTTGAACCATCCTAAG TCGGGGACTGTCTGTCCACCCTTGCCGA CTTGACCTCTTTTTCCCGGTTCTCTAGAG TCAGTATACCACCAGCCCGTTC | 0.000235082 | 0.00711415 | 4.83E-06 |
| 1861 | 2330579 | 5 | GRIK3 | GTTTCTGAAATATGAGCCAGCCTTGACA GTCACGATGCCCATCCACCCGACTGGG CACCTCCTGTCCTGACACCATCCTG | 0.003259761 | 0.007150962 | 7.11E-06 |
| 1747 | 2330744 | 2 | DNALI1 | TTCCACATGATTAATTTCCAACAAGACA CTTGGGAGTTATTTACTGTGTTCCTCTGG CAGCCAATAAAATCA | 0.001040005 | 0.007171718 | 4.91E-06 |
| 403 | 2332283 | 2 | FOXO6 | TCAGTTTCATTTGCGGAGGCCTAGCCGT GACCCCGCGCCCACCCCAAACACGGATC TGATTCCCACTTGACACACTTTCCCACTG GTCTTAGTCTCACCCACCCGAAGCCAGC AACCCTCTGCGGAAAACTCACA | 0.000604099 | 0.012992693 | 6.72E-06 |
| 1225 | 2332781 | 4 | C1orf50 | GTCTGCATTGAATAGTGGGGATCCCCTC AACAAAATTTTCAGGAGGAGGAGGATAT CCCTGTTATTTTCCAGAATAATCAGTGAT ACTCTGTGATATTGATAATCTACCTTGTT GGCCCTTACCAAATTACTGGGTGTGAGT AACAGCTGACTGTAGCTCCCTTTCTCTAC CCTAGTGCTCTGGAAGGAGGAAAGGAG AGCTGGCTTGTATCTTACTTTCTCAAGTT ATCAGTCCACAAACATGAAGAGTATTAG TGTTACAGATACAAAGATGATAACTACT GTCTTATGAGCCTTTATTCTGCTAAGTGT ATCCATTATCTCTTTTAATCTTCACACAA | 0.021592904 | 0.006558798 | 3.37E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CCCACCATCAATGAGGTATATAGTATTC TTATGTTACACAGCAGGAACATCTCAGA GATTCTGAAACTGGCCCGTGGTTATACA GATGGGAAGTGGTAGAGGTCAGATTCAG ACACAGTCCTGTTTGAGTCTGACCATAA CCTTAATCCTG | | | |
| 976 | 2334624 | 2 | TSPAN1 | CCCAGTGCTCTACTGGGGGATGAGAGAA AGGCATTTTATAGCCTGGGCATAAGTGA AATCAGCAGAGCCT | 0.018262733 | 0.006574417 | 5.96E-06 |
| 1628 | 2337238 | 9 | HEATR8 | ACTGGATTCTCTCTCAAGCTCCGTCCGCA AGCAGGCCATGGA | 0.000113163 | 0.008182282 | 4.36E-06 |
| 104 | 2337538 | 3 | RP11-90C4.1 | CCTACATGTCTATGTTCAGAAGCTGCCTT GATGCCACATGCGGGAGGCTGGAAACGC TGAAGGATGACCACTGCTCAGCAGCAGT CTACCAGTGATGGATGAGAGTTGGTGCA CAAATACCCCAGCTCCCTTGCCTCTCAGT TTGGATAATC | 0.000731459 | 0.018213477 | 1.45E-05 |
| 832 | 2337700 | 5 | PPAP2B | ACCCAGCCGCCTTTAGATATTTCTAAAAT GGTGCAGCCACTATGAAAACAGTTTGG CAGTTCCTCAAAAAGGTAAATGTGGAGT TACCATAGGACCCAGCAATTTCACTCCT AGGTAGTAGGTTTCTCTATGAAATCTTCC AAGATAAAAATAAAAAGAAAAACAAAA AGAAAACTTCATTTGCTCTCCTCGTTCAC CAAAATAAAACTCAAATTCCTTAGCTGC CTGCCATACCCAGTCCCCTTTCATAATCT AGCTCTAACCTATCTCTCCAGCCTCATCT CCAATGTCCTCCTTTCTTCCCCCGCACAG TGCAAACACACAATATTGACATTCCAGC CTCCAGCTACTCACTCTTCCCAAATAGGT CCCTGCTTCCAAGTCTCAGCACCTGTGCT TCACTCTGCTGCAATACCTTCTCCCCCTT CCTGGCTTGTGAGCTATTATTTATCTTGC AAGACCCAGCTCCACACCCTCAGGCAAG CTTCATCACTCTTCACTGTGCTGCTAGAG TAGGCCCTCCCTTAAGGCTCCAAAGTCA TCACTTATATAGTGTTTGTCATTAGGCAA AAGCCTGTTCCACTTTCACCAGCCTGGG AATTCCTTAAGGCCATGGAAACCCTGGG GCCTGGCATATAGTAGGTGCTCAAGAAT CATCTGCAGAAGACAAGGCTTATACCTG AAAGACAGGTACAAACATAGGCTTAATA GGCTCTCTAGAAATTATACTGATTGATA CCACAAACTAATTTGGGGGCCAGATATA AAGAAACCATCAATGAGAATGGTTTCCT TCGTGTCAATGTAATAGTGTATTATGTGT TTTAGGGATACATAAACAGGAACCAAAG CACACTACTTATTATGACAAGGCGCTTA TAATGATTTGCATTTCTCTGCAAAACTCT TTAGGCATATAATTTTGTTAATTTGTGAC AAACCTCAAAAACACACTTACCACCAAT ACCTTGATTGCAATATATACTTTCAAATC ACACAGAAATCAAGTTCCTTTCAAAGGT TTCCAAAAGAGTCTGAAGTGCGTTGTTTT GTTTGGTTTGTTTTAAATTTGGGAATTTA AATGCAGATCATAATTTATAATTTAACC CAGACTTAAGGGAAGAATAATTTCACAA GGATGTTCAAGAACCTGACCTAGCCTTC TTTTGAATGTTGGCACTGACAATGCGTG ACCTTG | 0.00035324 | 0.006977438 | 4.81E-06 |
| 451 | 2338845 | 4 | NFIA | GTGATCATCTTTAACTCTGCTTTTCCCAG GGCTCTTTGAACTCTTGTTTTATTAGGTA ATATGCTATGCTGTTATTTTATTGCTGTT TAAAAAACCTTCTCTTTTGGGAAAGAAA ACATGTGAATTCTTTGGTTTCTAGATAGA AATTAGCAATCTTTTGCTCGGAATGTAA AAGTATGCTGTATTATCACAAACTGACC CTCCTCCTCCCCAAGAATTCTAGGGAGT AAAATGCGTGCACA | 0.002123679 | 0.009137592 | 7.92E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 414 | 2343884 | 4 | LPHN2 | GTCAATTTAAGCCACCTTTCCTGTGTCAG GGATCAATGTAA | 6.92E-05 | 0.01266909 | 6.27E-06 |
| 1141 | 2344229 | 6 | | GCTGTTTCTGTTGATCCCAACCCTACATC AGAAGGGATATCGTCGTGGCTATGATAA CTAG | 0.000731459 | 0.006584977 | 4.40E-06 |
| 1197 | 2345198 | 9 | HS2ST1 | TGGCCTTCGCGGTGGCGATGCTCTTCTTG GAAAACCAGATCCAGAAACTGGAGGAG TCCCGCTCGA | 0.005416181 | 0.007195699 | 2.34E-06 |
| 2026 | 2345779 | 7 | GBP4 | CCCTCAATTCTAGCTGCAAGTTTTGAGCA CTAGACAGCAGAAATAAATTCCTAAAAT GTTGAGTTGAGCAAATAGTTCAATGCTA TCCCT | 0.000276837 | 0.007850394 | 6.56E-06 |
| 668 | 2348920 | 4 | CDC14A | ACATGCCTTTCTAGCGGCAGCCTCAGCT CCACCTGGAAACTTGTTAGAAATGCAAA TTCTCAGGCCCTGCCTTTGGCCTACTGAA TTAGAAACTTGAGGTGGGGCCCAGCAGC CTGTGTCTGTGGAACTATCCGGGTGATG CCAATACACACTAAAGTTTTAGAGGCCC TGGTCTAGAGAGAGAGAGTATGGAGTGA GAAGAATTTTGGTCTAGAGTTGAACCTT GAGAAGGTTTGACTTTTAAAGACTGGGA AGTGAAGGATGACTTTGCAAAGGAGGTT GGAAGTAGTGTTTAGAGGGTAGAAGGA AAATCCAGGAACCAAGAGAAGAGAGCA AAGTAGGGAGTTACTTGTTGCTGACATA TTAGGCTAAGATGATGCATGCACAATGT TCTCTGGGTTTA | 0.023196567 | 0.007069116 | 4.57E-06 |
| 761 | 2348926 | 4 | CDC14A | CTGAGGATCTCTTAGCGTGTTTAGACTA GAGGCTGATAACTGGTGCTCAAAGTCAG CCAATGGGCATGTTTTATTTGGTTTCACA GGAGTTAAAAACCTAATTTAAAAAGTCA ACATTTTAAAAAGAGAGTTTTCACATGA AAATTCAGTTGGAAGATCAGCTGTGTTC AGTTGGCTTTCCTACAAGGTGTCTCATTA GCTGGAGTGGAGGAGCACCTGACTCTAT GTATG | 0.015428709 | 0.007499352 | 5.74E-06 |
| 1586 | 2349294 | 8 | RP5-936J12.1 | CAAAACAACAGCGAGTGCAAGAGGACA CAGCAAATTAGAGAATGCATGCCCCTAT CTAACAGATGCG | 0.0015655 | 0.006876156 | 5.64E-06 |
| 1770 | 2350297 | 3 | PRPF38B | GTGGTTTAATGTCTTCAAGAACTTCCTGT AGTTAAATTTATTTCAGTGAGATACTTTT GGAATTAAATGTCCTTTTACTGAGACCTG ATGGCTTTTATGTATTTTAGGGTAAATTT CTGAAGTTTTATTTCTTGTTTTTAAAATT GTTTAAATGTGTTTGGTAACTATTGGAA AATTTTCTCTTCTTAATTATGTTCTGTGT ATTGTATTGATCCTGAATTGTATAGTTAA TAGTGACTTTTCAAGATGGGGCATGCTC AAGATCGAACAGATA | 0.000683093 | 0.006540911 | 5.89E-06 |
| 734 | 2351311 | 4 | KCNC4 | TGGCAACAGTAATACAAGACGGATCATG AGAGGTGCCACAGGAGTCGTAAGAAAA TAAAGTTCAATAGGAAGTGAGAGG | 0.000115017 | 0.008419847 | 6.31E-06 |
| 583 | 2351412 | 6 | | ACTGGTTGAACAGCGGATGAAGATATGG AAT | 0.000118813 | 0.013583363 | 8.53E-06 |
| 593 | 2351598 | 3 | RP11-96K19.2 | TTGGGAGGCCTCAACCATTCCTGAGGTA CTGGTGGTGGCAGTTGCAAGTATCTTTTG CTGCACTGAAGGAGGCAATGATGACGCT GGTACAGATTTCACTTCAGCATGGGCTG GAATCTGTAAATGATGCCCAGAAGGCAA AACTGGAGACTTCACAGTCACTGGAAGA CTCTGGGTATTAACTACAATAAAAGATG AGTCTTTTTGTGTTGAGGGAGGAACAGC AAATGTTTGCATGGTGAGTCCATCAATTT TCACACCATGACTCTGAACTTTAGAAAC TGATGAAGAAAATTTCCAGTTCCCACA GAAGTAACTCTACCTTTTTCTGATGTATC TACTGTTCTTGTAAGAAAATAGTTTGAA GAACTGGCTGGCTGAAAATGGGCAATT GAACTGATGCACTTGTGGAAGAGCTGGA AATCTGAGTCTGAAAAGTAACTTGAACT | 0.010913939 | 0.012701614 | 1.35E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 932 | 2352425 | 6 | | GGTTTTCCTGTATTCCCTTTCAAAGCATC AGACATGACTGAAGATTGAACTAGTGGT ATAAGATTTCCAGAAGACTTAGGAATTG GAAGTAATTGCAGAAGATTTTTCCATC CGAGCCAATCGTCTGAACTACTTG GGAAAAGTCAGCCTCTTACACAAGGTTT TGTATCTATACTTTTACTCTGTCAATTAC AGTGGTATTTTAAATGCATTGAATATAA TTCATTGAATGTCTGTATCTTTCTGCCTC GATTTAAGTGATATTAGGTTAAAAAAAT ATTTACAGTTTTCATTCTGGTCCACCTTC CCTCCTTATCCTTATACTGAATCCATTTC TCTACTTTTCAGGTAAGTGAAAGGGGTC ACAAAATTTTAGGTTTGTGTGGAGGGT AAAAATGCATCCAGCAATTCTAAGCACA ACAATTTTCTGTAAGGCCTTCTCTGAAAA AAGAGAAGGAATTACTTATTAAAACTAA GCACACTTAGCAACTTCTTTCCCAATCCT ATCTTTATTCGTTTGCCTGGTGCCAAATT TTTCTGGCC | 6.62E-06 | 0.01526752 | 1.41E-05 |
| 474 | 2352537 | 9 | LRIG2 | GTACCCGGGTGATTTGCTCAGATTGTTAT GACAATGCCAACATCTACTCCAGGACCC GAGAATACTGTCCATACACCTATATTGC TGAGGAGGACGTTCTTGATCAGACACTG TCCAGCCTCATGGTCCAAATGCCTAAAG AGACATATTTAGTACATCCTCCCCAGGA TACTACTGCCCTAGAGAGCCTGATACCG TCAGCCAACAGAGAGCCATCTGCCTTTC CCACCAACCATGAGAGGATAAGTGAGA AGAAACTTCCCTCCACACAGATGAGCGG TG | 0.000177948 | 0.011098091 | 8.26E-06 |
| 796 | 2353802 | 4 | TTF2 | GCCAGGGAAGTGGAGTTGGAGCCACAG ATGGTTTAATGGGAGTCTTTCTCAGCCTC CACGATAGCAAGAGGACCTCCCTGGAG | 0.005280805 | 0.007398234 | 4.66E-06 |
| 1426 | 2354664 | 4 | PHGDH | GTCCTTTAGCTCTCTGGTGAGTGAATAGC CCTGAGTCCCAGTGAACCAGGTGTTGAT GGCTCTTTTGAGACTTTGGTTCCTGTCTT CTTAGTTTAAAAGAATTTAAACAAGAGA CACGGTGCAGCATTGAGGAGTTTATTGC AAAGGAAAAAGAATATTTTAGAAAGTTAA GTGCAGAGTAGACAGTACACCTCGGGAG AGA | 0.00022254 | 0.008825131 | 7.03E-06 |
| 859 | 2354667 | 3 | PHGDH | GAAACATGGCTTGGATCATTCCGTCTCC CACCTCAGCCCCTCCGGAGCTGCCTGGA CCTCATCATTCCGGAGAGTCTAAGTGGC | 0.001151831 | 0.007373918 | 4.66E-06 |
| 61 | 2355118 | 6 | | GTCCCTAACGTACTGGACAGAGCTAGGA AAGCAAACCCATTTGCTTCTTCCTGCAG GAAACCCCTTGAGG | 0.033605237 | 0.024962916 | 4.91E-05 |
| 717 | 2356711 | 5 | FMO5 | TCCGATGTCATCAGTCCTTTCAAAGCAG ACAGGTTCCAAGCCTCTTCTTCTACGCAGC ACTTGATGGAAGAGAGCCCGCTCACTCC TCCCCCAATCACAGCAATTCTTTTCTTAG TCATGGTCTCCCGAGATCTTCACCTGTTA GTGTC | 0.00032469 | 0.011169866 | 8.71E-06 |
| 1815 | 2358768 | 4 | PIP5K1A | GCAGACTTCTTGGAGTGGTAGTTCATGG TCTTCTTCTAAGAAGGCTGTGGATGCCTT AAAAGCATTATTTGACGCTGGCTCCCAT ATCTCACTGCCCTCTCCAAAAAATGTGTT ACCCTAACATAGAAGTATCTTTTCTCAG AATTCTTCAGTATATTATGAATCAGTGAC TACCTTTTCTCTCCCTTGAAATTTTCCTGT AACTTAATGTTCATTTCCTTTTGTTTCAG TAAACCAGTCTCAACTCTTTTCCTTTTCT CTTTCTGTTGTACCTCTCATTTCCCCGAC CCTTCCTGTCCTGTAGATGCATTTCATA ATTCACATTGATAATAATTGCTAGAATTT ATAGGCATTTATTGTAGATTAAGTAGAG CATTTATTATAGATTAAGCCTATACGTAA CTTGTTGAATTCTCATAACAACCTTAGGA AGTACATGTTGTTACTTCCACATTTTATA | 0.001426456 | 0.006739963 | 5.31E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1906 | 2358817 | 4 | PIP5K1A | GATAAGGTAGCCAGTCTGCTCTAGAGAAATTTTA TACAGGGCCAGCCTTCTAGCCTTTAACA ATTCAGGAAATCATAAACCATCACTTGT TCCTGCCAACTTCCTAATTCCTCTGGTAC CATGCAGACAAAGAAACACTCTCTTCCA ATCGCAAATAAAATCTTTTTTCTCTTTTT TTAGGTGGACTCTTGCTCTTGTCACCCAG GCTGGAGTGCAGTGGGGTGATCTTGGCT CATTGCAGCCTCAGCCTCCCGGGTTCAA GCGAGTTGCCTGCTCAGCCTCCCAAGTA ACAGATTACAGGCACCTGCCACCACATC TGACTAATTTTTGTATTTTAGTAGAGACA GGGTTTCACCATGTTGGCCAGGCTGGTC TCAAACTCCTGACCTCAGGTGATCCACC CATCTCGGGCTCCCATAGTGCTGGGATT ACAGGCGTGAGCCACCATGCCCTGCCAG TAAAGTCTTTTT | 0.00011347 | 0.008659372 | 2.79E-06 |
| 1344 | 2358866 | 9 | ZNF687 | TGCCCGTCTGTCAGCCCTTGAAGGAAGA AGATGATGATGAGGGGCCAGTGGACAA GTCTTCCCCAGGAAGTCCCCAGAGTCCC TCTAGTGGGGCCGAGGCTGCAGATGAGG ACAGCAATGACTCCCCTGCCTCCAGCTC CTCTAGGCCTCTTAAGGTGCGGATCAAG ACCATTAAAACATCCTGCGGGAATATCA CAAGGACTGTAACTCAGGTCCCCTCAGA TCCTGATCCACCTGCCCCCTTGGCTGAGG GGGCCTTCTTGGCTGAGGCTAGCCTCTTG AAGCTGTCCCCTGCAACACCTACTTCTG AGGGTCCAAAGGTGGTGAGCGTACAGTT GGGTGATGGTACAAGGCTGAAAGGCACT GTGCTGCCTGTGGCCACCATCCAGAACG CCAGTACTGCCATGCTGATGGCAGCCAG TGTGGCTCGCAAGGCTGTGGTGCTGCCT GGGGGGACTGCCACCAGCCCTAAGATGA TTGCTAAGAACGTGCTAGGCCTGGTGCC CCAAGCCCTGCCTAAGGCTGACGGGCGG GCAGGGCTGGGGACTGGGGGACAGAAG GTGAATGGTGCCTCGGTGGTGATGGTGC AACCTTCAAAGACAGCTACTGGGCCAAG TACAGGGGGCGGCACAGTGATATCACGG ACCCAGTCCAGCCTGGTGGAGGCCTTCA ACAAGATCCTCAACAGCAAGAACCTGCT CCCTGCCTATAGGCCAAACCTGAGCCCA CCAGCTGAGGCTGGGCTGGCCCTGCCTC CCACCGGCTACCGCTGCCTGGAGTGTGG GGATGCCTTCTCATTGGAGAAGAGCCTG GCACGGCACTATGACCGTCGGAGCATGC GCATCGAGGTCACCTGCAACCACTGCGC CCGCCGCCTGGTCTTCTTCAACAAGT | 0.047189944 | 0.007896143 | 2.93E-06 |
| 318 | 2359022 | 4 | TUFT1 | CCCACCTGAGCTTGAGGGTAGCATACTT AGGATTTGTCTATTTGCAGAATTGTTTTG AGAGCCTAAGGCCCCATAACTGGGAGGC TGTATGTGCTTCATGTCAGCTCCATTAGT GTCTGTTTTATTTAGTGCTGTTTTCCATT ATCTCGAACAGAGTCAGTCATATAGTA | 0.008412239 | 0.019281699 | 2.24E-05 |
| 1991 | 2359172 | 7 | S100A10 | GCTAAGTGTCCTGATCTGCTCATGAAAT CCTTCTATGGGGAAGCTGTGGGGCAGA TTCCTTAAGCGACCCTTTGGGACAACTCT TATCAGGGAGGAGCGAACTGCT | 2.46E-05 | 0.008579579 | 1.13E-05 |
| 1973 | 2360177 | 9 | HAX1 | AGAGACTACAGTAACCCGACACGAAGC AG | 0.000475873 | 0.007177691 | 5.19E-06 |
| 619 | 2361306 | 4 | LMNA | GTGGTGTGTGTACTTGTTATATTTAGCCA CCTCCCTCTGTTCTCCCCACTGATCCTG GCTGAAAGGCTGGGCTTCCGGAAAAGA GAGGTGGATTTGCACACCTGGATCCCAA GCTGATAGAAAGTGGGGTGAAGACAAA GGGGACTCAGACTGGGGTGTCTGTCCTC TTCTATGCCCACAGTAGGAGGAGCCAGG ATTGGTTACTCCCTGC | 9.15E-05 | 0.010680811 | 5.62E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 60 | 2361561 | 7 | IQGAP3 | GCAGGACTGCAGATCTATGGAAATTGCC TGGAAGAGTCAGCTGTAAGGGATGAGA ATCCTGAGGGTAAAAGAGAAAAGGGAA AGACTCCTCTTTGATCTTATGAAGCTGAA ATAACAAGATCTTAAACATGAGTGAGAA TCTGTTGCCCCAACCTAAGGTGACTTTAA ATCCAAGGTAAAAAACACGGCATGGGTA TTAGTTTGAATA | 6.53E−05 | 0.052285286 | 7.62E−05 |
| 591 | 2361774 | 9 | NTRK1 | CTGCAGTGTCATGGGCAAGGGCCCCTGG CCCACATGCCCAATGCCAG | 0.001689593 | 0.009588501 | 9.17E−06 |
| 1397 | 2361937 | 1 | | GGTCTCAAGCTGGACGAAGGGGAGCCCC AGGTCACCCTGAGCGCTGGGGCCGCAGT GGGAACTTGCGGCGATGTCACCCCTGCC CTGC | 0.008429307 | 0.011369338 | 9.16E−06 |
| 1609 | 2362760 | 2 | SLAMF8 | TGGGCACCGTTTTGCAGGAAACACCATA TTAATAGACATCCTCACCATCTCCATCCG CTCTCACGCCTCCTGCAGGATCTGGGAG TGAGGGTGGAGAGTCTTTCCTCACGCTC CAGCACAGTGGCCAGGAAAAGAAATAC TGAATTTGCCCCAGCCAACAGGACGTTC TTGCACAACTTCAAGAAAAGCAGCTCAG CTCAGGATGAGTCTTCCTGCCTGAAACT GAGAGAGTGAAGAACCATAAAACGCTA TGCAGAAGGAACATTATGGAGAGAAAG GGTACTGAGGCACTCTAGAATCTGCCAC ATTCATTTTCAAATGCAAATGCAGAAGA CTTACCTTAGTTCAAGGGGAGGGGACAA AGACCCCACAGCCCAACAGCAGGACTGT AGAGGTCACTCTGACTCCATCAAACTTTT TATTGTGGCCATCTTAGGAAAATACATT CTGCCCCTGAATGATTCTGTCTAGAAAA GCTCTGGAGTATTGATCACTACTGGAAA AACACTTAAGGAGCTAAACTTACCTTCG GGGATTATTAGCTGATAAGGTTCACAGT TTCTCTCACCCAGGTGTAACTGGATTTTT TCTGGGGCCTCAATCCAGTCTTGATAAC AGCGAGGAAAGAGGTATTGAAGAAACA GGGGTGGGTTTGAAGTACTATTTTCCCA GGGTGGCTTCAATCTCC | 0.000293755 | 0.008851971 | 3.93E−06 |
| 415 | 2362943 | 2 | ATP1A2 | TCAGCAGGCTAAGTTGCGGGGTATATAA ATTGGGGTGATGACCCCATAGACCTAAC TGTGAACAATCAGATTAGACACTATGTG TTAGAGTCCCCCCGACCAGATCCTTTTCC ATCCCACTCCACTATGTTGTCTATTTTTT CTGAGGAATTAAGGGTTACCCCACCCTG CCCACTCCCATCCCTTCAACCCCACTTCC TACTGTAATAGATCAGCATCCAAAAGCA GGAACCCATCTAAACCAGAAGG | 0.000931652 | 0.010267038 | 8.99E−06 |
| 1121 | 2363443 | 7 | RP11-297K8.2 | GCACATGAACAGCTACGCCGGGTTGGGT TGGGAAAGAGTCGGAAATAGGGGATGC TCTGGTCAGGAGTGGGAATGAAATGTTG ACTGTTCCCCCTGCTGCTCAGATCTACCT TTGTCCTTTAGTGGTGAGCCATGCTTTGC CCTACCGTGTTAGCCTGCAAGAAGTGGT TTTGCCGGACCAGCACTTCCCGCCCTCCA GGGATCTTCCCAGCCCTCTGTGAAGTGC TAGATGCTTCTCCACTGGTCTGCGGGCTG GACCCAGGCCTGCAGTTTGCCATACTTG CGCCCCTGCTGTTTGGGAAGGATCTGTG CTGTAAGCCTCGCGGCCATACTACGACT GTCAGATCTCCATCCCTATGGGCTATAG GATGGGCGACGGCACCCTATACCTCAG GGACTTGCTTTGGA | 0.000105163 | 0.008348104 | 5.02E−06 |
| 1478 | 2363596 | 2 | TOMM40L | TCCTGCATGGGATTAGCTGACCATCCTGT TTTCCATCCCAGAGCCTCCCAAGGCTGG GAAAGTAGGGCTGAAGGGCTAGATGTTT GGTCTCAGGAAGTGGGGCCCACCCATTC CCAGAAGGAGCTTCTTTACCTCTTAGCCC TGAGGTTTCCTCCTTCCCATCTTCTGTGC TTCCAGAGAACAACTTTGTTCCTATGGTC | 0.001351803 | 0.006766808 | 2.02E−06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ACCCCCACTATCCCCATGACCGCATGAA GAGGCAGTTATTGCTTTAGTCTTTCATTG CAACCACTGGGCTCCCTTTGAACCCGGC CCAATCTTTGGTCCCAGCATTTTCCCACT CCAGTGTATCCAGGGTGTTCCAGGTGAG CTGGGGAAGGAAGTGAGCATGGCCTCAG CTGCAGATCTCCTGGAGCAGCGGCATCA TGGCAGACAGGCCCTGGATGTGCTGGAT TTGGTACCCGTAGGCCTCATTAATGCTCC GGAGCTCAGCCAGCAGGCCTAGCAACTT CGCATACAGAAACCTTTGGAGGAAGTAG TGGGGTTGCCAGGAAAACAGGAGGGAA ATAAGGCAGTTGGGAGTCTTGTCTCTAG GCCCTGATCCCCTGAACTATTCCTCAGTG AAGCCAGGTCTGAACATTAGAGAAAATC ATGCTCTGGTATGACAGACTATCAGAGG TTCCAAAGGTCCTCCAGGGGGCCTCGGT CTGACACTGTCTTCTCTCACCATGCTCAG TTTTTTCTGAACCCAGAGCTCTGAGAGCC GAGTGTGAAGAAAGCTCCAGACTTGGCC AGAACTCCAACCATGTGGA | | | |
| 1807 | 2363918 | 2 | DUSP12 | GTGCTGCCTTTGCTTCTTATCATTCATGG CAGATTGTTTGTGCTTTCAACATTTCATT TGAAATGGGAGAAGATAAAATCACTTGA TGTAACCTGGAAACTATGCTTTACATGG CAATCAAAGCCTTTTG | 6.39E-06 | 0.008024841 | 5.36E-06 |
| 1775 | 2364168 | 9 | UHMK1 | GTGTTTACAATCCACTTTTCTCCAAATGT GCCATCACGCTGTCTGTTGCTTGAACTCC TGGATGTCAGTGTTTCGGAATTGCT | 9.30E-05 | 0.006583588 | 3.54E-06 |
| 1636 | 2365136 | 4 | MGST3 | AAGAAGCAACACCATTCAGTTCAGAACA CCCATACTGACTTTGAGCTGATGGCCTTT GTAGGTTTCTAACTGGAAGTGAAATTTTT TCTATTTTTAAAACTTTCTTTTTATTTCAT AGTTACTTTTTAAGCTTTTTTTGTTAAAA ATTAAGACACAAACACACACCTTATCCT AGGCCTATACAGGGTCAGGATCATCAGT ATCCGTCTTCTGC | 0.001286836 | 0.006751106 | 3.74E-06 |
| 1433 | 2367711 | 8 | AL645568.1 | ATTCCTGGGGCACCCCTGACAAAGGGAG TCAGTGGGCCACCAGATGGAGGAAGACT CGGTGCAATCCCACTG | 1.65E-05 | 0.009625929 | 4.05E-06 |
| 1255 | 2368310 | 8 | KIAA0040 | CTGAGAAAGCCTTGAGCGTTCGGAGAAA GTCATCTGGAAGTCAACATATGATATG | 0.000252191 | 0.006744191 | 4.61E-06 |
| 1258 | 2369335 | 4 | C1orf49; C1orf220; AL513013.1 | GTGCCTGTATCATGTAGACAAAATCCAA AGCAGCTTGTTTCAGACAAAACATTTTG CTTTGGAAACTTTTGAAACTTCCATGGCC GTTGAATATAGCAGAGATGATCTAAAAA TTTTAGAAGCGGTTGAGGTACCCGTGGT AGGGGCAAGGCATGGGAGTGGTGATCCT TAAGGGGCTTGTCTTTAGTTTGAGGGCC ACACA | 0.004267545 | 0.007220492 | 2.75E-06 |
| 1571 | 2370215 | 9 | KIAA1614 | CTCGTACCCAAAACCTGCCTGATGGGCA GCTGGACGGCAGCATCAATGAGGAGCA ACCCGCCAGGGATG | 0.004407176 | 0.006575102 | 1.91E-06 |
| 1835 | 2371053 | 2 | DHX9 | AGGCATGCTATGTGTTACGTGTTTTTTCC AGTATGTTTATTTGCCACCAAAAGTAA ATGCATTTTCACCCATTCTGTGGTTCATT GTAGTTTAAGGAAACCAAGCATATAGAT GCATTAGTGATTTTGTTTATATTATGTAA AATATAACGATCTCTTAAAAATACCACA GTTTGTATTTTTTCTTTAAGGAGTAAAGA TTTGCCTTTAAATAACTTGGTATTTTCCT GGCTTTCGTTTAATACAATAGA | 0.001027681 | 0.009724721 | 7.95E-06 |
| 1246 | 2371206 | 7 | NMNAT2 | GACTCGTGTCCCAGGTTTCAGAACCCGA AAATCTCACTCCTGATCAAAGGTTGCTG CTGCTGCTGCTGCTGCTGCTACTGCTATA TGTGTGTGTATGTGCGTGCGCGGGTG CACACGCATGTGTGCGTGTGTGTGTGT TGCGTGTGTGTGGTGCTGAAGAAGTGGA GGTTGCTTGGCCTTCTCTACTGGGTGTGG CCCTGATGAACTCACTGAGTGCTGAGGC | 0.000742232 | 0.007072308 | 5.66E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1968 | 2373881 | 4 | PTPRC | TGGCTACAATGTCCTATCAGAGGGGAAG TAATACCACAGGAGCACATCAAGACTAC AAACATAAAGAACCATGGACACTGATTT CATCCAAGTTCTACAGGGAGTGA TGTGTCGTGGTATAGCAGAAGTGCTTGA AGATTTGTTTCTCTGCCTTATCTTTAGTA ATTGTGTTTATGTTGGCTATCTGGCTATT GCCCTTGCGTGAC | 0.003830941 | 0.008142194 | 4.66E-06 |
| 1910 | 2374274 | 1 | | GTGAGACCCTCCCGACAGGACAAACCAC TCTGCCGTTATATGTGA | 1.92E-05 | 0.007591419 | 3.48E-06 |
| 251 | 2375421 | 3 | RP11-480I12.3 | CGGTCTCTGCCTTGCTCGTGCTTCTACCA CCACCCTTCCCCTCCCAACCCGGTGGATC CTCTCGTCTCC | 2.80E-05 | 0.014753778 | 1.93E-05 |
| 1405 | 2376434 | 5 | KLHDC8A | CAAGGAGATTCCAGCGGCTGCCCATACT GTTTGTGCCAGGCAG | 3.24E-05 | 0.008440933 | 7.36E-06 |
| 276 | 2376513 | 1 | | CTCTGCAAGAATTGCTGCAGACCCTCGAA TACACCTCCTGCTGCTG | 0.000310846 | 0.011470781 | 7.56E-06 |
| 1891 | 2376804 | 4 | IKBKE | CTTCTGTGTAATGTCCGCTCCTACCTGAT | 4.25E-05 | 0.006524562 | 4.11E-06 |
| 1161 | 2377129 | 2 | PFKFB2 | ACTTGCATTGTGCTAGGGATCTGCCCTAT ATCTTTGCCTCTGGTGTTTCGTTGTTGTT GTTATTGTTTGTTTGTTTCCAAAGAAGTT GGAGTTAAGGACACAATATATTTGTACC CCTAGACTGAATGGGTGAGTATTCCATA TGAGGATCTGGGTAATCCTCTTTGCAAC CCACATTTGGTCTTCAGAGACACTGGCA TTTTGAAGAAACATATGATATAGCTGTTT GGAAATAAATTCATCTATGTTACTTTTTT TTTCTTTTTTTTTTTTTTATGAGCAGGA GATCTTAATTGACAGAAACTCATTGGTG GTTGGAGTGGCCAATGGGCACGGGAAA AAGTATCCAGTAATCAGAAGAATTGTAT CTGGGTTATGTAATCTTATGCACATTCCA TTGTCTTTGCCAAGCCCAGAAGCCATGTT GTGTTCATTGTTAAGAAATTTGATAGATT TACCCAGCTTTTCTATGTATTTTGACTTA TTGAAAATATGTAACAACTGAGTCGGGT TGCAGCACTGGTGGGTAGAATCGACTT TCCCTGAAGGTGACACAGATGTCAGAAT TGTGTCCAGGGATTTAATTTAGACCCAT ACTGTCCAGGAGACTGTCTCTAGTTGGA TCTCTGTGCTGACTGACTGACAGACAGA CTTTAGTGTCTGTGTGCTGACTGACAGAC TCTAGTAGTGTCTATATGTTGACCAACTG GTAGACCAGGAGGATCTGTGTGCTGATT GACTCTAGTAGGATCTGTTTGTCACTGAC AGACTGTAGTAGTGTCTGTGTGCTGACT GATAGATAGACTATAGTAAAATTTGGGT GTTGCCTGACTAACGGTCTA | 2.67E-05 | 0.01046144 | 7.14E-06 |
| 261 | 2378098 | 9 | HSD11B1 | GAGGAATGTGCCCTGGAGATCATCAAAG GGGGA | 0.012161553 | 0.014861289 | 1.03E-05 |
| 358 | 2379173 | 9 | FAM71A | TTCGCCACTGGCAGATCTTGCTATCTGCA ATTGTGTCCCGCTCTTGACACACGGGAT GACCTCTTTGCCTATTGGGAAAAACTAA TTTACCTCTTGCGGCCACCCATG | 6.53E-05 | 0.012088903 | 5.38E-06 |
| 467 | 2379454 | 9 | RPS6KC1 | GACACATTCAGCTAACGTATTTTAGCAG GTGGAGTGAGGTTGAAGATTCCTGTGAC AGCGATGCCATAGAGAGAATGTACTGTG CCC | 0.015937432 | 0.011695155 | 1.18E-05 |
| 811 | 2379471 | 4 | RPS6KC1 | TTCTGGTCCGTATGACTTTTGCTTTAAGA CTATTGCTCAAGCTATTTTGTAAGTTTGG GGTTCTCCCACACAAGTACATTGACTAA GCATTGGTTAAAAGGCTAGGCACCTGAG TACCACTTACATGTTTTACTTTCCAAGTT CCAACCTAACTACTTATAAACTTGAAAG TAGTTATGAATTGTGGGTTACCTATAGTC AAATAGTAGGGTTTTTTTTTTTCAGTC AATTGGAAATGAAAGGGCAGGTATTGGC AAGGCTTCGGGACTAATTTA | 6.60E-05 | 0.011990906 | 1.17E-05 |
| 572 | 2379903 | 9 | CENPF | ATTGAGCATGAAGCCCTCTACCTGGAGG CTGACTTAGAGGTAGTTCAAACAGAGAA | 2.09E-05 | 0.019043146 | 1.94E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GCTATGTTTAGAAAAAGACAATGAAAAT AAGCAGAAGGTTATTGTCTGCCTTGAAG AAGAACTCTCAGTGGTCACAAGTGAGAG AAACCAGCTTCGTGGAGAATTAGATACT ATGTCAAAAAAAACCACGGCACTGGATC AGTTGTCTGAAAAAATGAAGGAGAAAA CACAAGAGCTTGAGTCTCATCAAAGTGA GTGTCTCCATTGCATTCAGGTGGCAGAG GCAGAGGTGAAGGAAAAGACGGAACTC CTTCAGACTTTGTCCTCTGATGTGAGTGA GCTGTTAAAAGACAAAACTCATCTCCAG GAAAAGCTGCAGAGTTTGGAAAAGGACT CACAGGCACTGTCTTTGACAAAATGTGA GCTGGAAAACCAAATTGCACAACTGAAT AAAGAGAAAGAATTGCTTGTCAAGGAAT CTGAAAGCCTGCAGGCCAGACTGAGTGA ATCAGATTATGAAAAGCTGAATGTCTCC AAGGCCTTGGAGGCCGCACTGGTGGAGA AAGGTGAGTTCGCATTGAGGCTGAGCTC AACACAGGAGGAAGTGCATCAGCTGAG AAGAGGCATCGAGAAACTGAGAGTTCGC ATTGAGGCCGATGAAAAGAAGCAGCTGC ACATCGCAGAGAAACTGAAAGAACGCG AGCGGGAGAATGATTCACTTAAGGATAA AGTTGAGAACTTGAAAGGGAATTGCAG ATGTCAGAAGAAAACCAGGAGCTAGTG ATTCTTGATGCC | | | |
| 845 | 2379907 | 9 | CENPF | AGAGAAAAATAGGCTAGCTGGAGAGTT GC | 4.92E-05 | 0.016468854 | 9.51E-06 |
| 525 | 2381284 | 4 | MOSC2 | ACTGTCTGTGGCCTAAAGTACTTTGTACT TTGTCCGTGTAGCTCAGAATATTAAACG ATTTTTAAAAGGCTGCTTCCTTGGGTCAG TGTGGTGTGCTTGAGTTCCGGGAATGCA GCAAAATGAAGTTTAGAAATAATGAAAT TGACCAATGCTTCCTATCTCTGTAGTTGG CCATTGTGGGTCAGTGTTTACTGATCTT TGCTCACTGTCCTGATGAGATAAACTTG | 0.000881522 | 0.01234807 | 6.65E-06 |
| 539 | 2382372 | 9 | DEGS1 | TCTGGAAGTTATCAATACCGTGGCACAG GTCACTTTTGACATTTTAATTTATTACTT TTTGGGAATTAAATCCTTAGTCTACATGT TGGCAGCATCTTTACTTGGCCTGGGTTTG | 3.86E-06 | 0.020088544 | 1.45E-05 |
| 316 | 2382373 | 4 | DEGS1 | TGGCCAGGCTAGTATTTTGTCAGTCCAA GCAGTTCATTAAAAAAAAAAAAACAA AAAGAGCAAGAATATAAATACTGCATCT TCCAGCCTACTTTTACAAAGGGTTCACTC TTGGGTCCTTAAGCTTAGTGGT | 6.13E-05 | 0.019451886 | 1.79E-05 |
| 1948 | 2382443 | 2 | CNIH4 | CCGTGGTTGAAGTCAGCCTACACTACAG TGCACAGTTGAGGAGCCAGAGACTTCTT AAATCATCCTTAGAACCGTGACCATAGC AGTATATATTTTCCTCTTGGAACAAAAA ACTATTTTGCTGTATTTTACCATATAA AGTATTTAAAAAACATGAATTGAGTTTC TGTAGATTTCTAGTTCTCAACTTTAGCCT GAACGCCAACACTTGAAGGTGTTTTTCA TCCTCTGTATGTTGAAGGTGGTTATTTGT ATGTAGGAACAGGACTGCCATCCCAGCT TTGCATGCCAAAGAATAAAGAACACAC TTTAAAGGGCAAACTGAAGAGATGAGCG AGCAAAGGTGCCCTTCAGGTCTACTGAA AAGTTAGAGTACAAAACAACACTGTTGA TCTGGACAAAAGAAGAAAAATTACCCTT TTTGCTTGTGTTGTGACAACTTCATTTAA TATGGTTTAAAGATTTATGAGACTGTCA GCTAAAAGTCTTTTCACAAGAATGTCAA CAGAGAATGGCATCTCAAAATATATATA TTTCTTTGCACAATTTGTGAAACCTTATA AGCCATTTTCCCCAGGTACAATGTAGTTC CTGCTGATAGAAAGGAAATATTTTGTCA AGAGCTTTCATTTAAAAGCTACTACCTCC ACAATCACCCCCAAACCCAGAAAATCCC | 0.000243178 | 0.008587751 | 4.58E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CACTGGCTCTTGCCAGTCTGGTTTTCGTA TTGCAGTTATTCCAATTGTATTTGATCTC CCTGATAACGTATTTTCATGGGTTTGGGT AGAAGATGCTAATCAGATTAGAAGCAGG AATAGTTATTTGCTGTCTGTGAAATTGAG CCTTTTGGTGCGCCACGTGGTGCCAGAT CAACACTTCTATCCCTCTGCACTGACCAC GTTGTGAACTGGGAGACCAAA | | | |
| 1652 | 2382480 | 4 | CNIH3 | AATCTCAGTTGCCAAACCTGTGTCGGCC ACATTAAAGCAACAGTTACTATATCAGT CATGG | 0.002187152 | 0.006827297 | 3.25E-06 |
| 1435 | 2383093 | 5 | PARP1 | CCCGGTGGCATACATTGAATGCCTAGGG CAGAAAGGAAGTGGGAATGGCGAAGAT GTGACGTGCCTCGGTGTTAGATACTGT | 0.017390197 | 0.00692499 | 4.35E-06 |
| 743 | 2384613 | 5 | C1orf96 | AGGCACCATCCATATCACAACGCTGCCT AAAAATTGTATTTATATTGCATGCAAAT ATTTGACAACTCCATCACAAACAATAAA AGATCGGGAGAGAAAAGCCATTTAGCC TGATAAAGTACATCTCAATTTAGCTAGC AGATCAGTACCCACAGGAATAATCTGGA AGGCATGTTCCCTACCCCCTCCACCTTCT GTTATTTGCATTTCTAGCAGTGATCACTG AAGCATCAGGATTTGTGGGGATTCACAA GTAACATCATGATGGGAGGAGGCAGCCC TGCCTCCGATGATGAGCTGAAAATAGCT GAAGATGGTAAAACCAAGAGCAAAGCA ACCCGGCTCATAGCCGAAATTTCATCTC CTCCTCAGCCTCTCACAGAGAAGCCAGG AAGAGTCTGATTGGCTTGCA | 0.00026838 | 0.007981474 | 5.05E-06 |
| 1238 | 2386188 | 5 | IRF2BP2 | AGGTGGGGCCTGTCTATTATATAAAACC CTTAATTTCTTTAATTTCCACTAGTTTAT CATTTTTTTCCAGAACAGTATTATTCACT TGGTATTTCAAACACATGTTAAGAAGGA AATTACAGGTTTCCTCCACCCACATTTGG GCTGTCACTGATATGCCCAAGGGCAGTC CTGGCAGCACCACGCGGCTGTTACTGTC ATTGTACCATACTGTATTCAGCACTCACT AGAAACAGGGTATAGGTGATAGTATCAA CAGCAATAGCACTACAGGTAAATGATAA ACAAAACAAAACAGAAACAAAACCAAT CCCACAATCTCCAAGTTCACCTGGACTG TAACTTCTCTTGCAACTCTTTCAAAATAA AGGACAACAGCAACAACAAACAGACCT CTAGGGTGTTTAAAAAGATGAAGTGGCG CTGCAGAGCTGGGCTCTGCTCAAAGATG GCAGTGCCATCTTGTACACACCACCATC CATTATAACCGCCTTCCATCACTGGAATT GTATCTTATGTAACCAACTAGCATGCAG CATTGTAATCTTACAACTGATCACGTGG ACAGTGAACAGCGGTCAACTTTGTCTTA AAAAAAAAAAACAAAAAACCCCAAAA GACCACACAATCCTGAAAATTTCCCAGC AGCACTCTCAGTCATCAGTATCTCAGGA ACTGAACTTTTGAGCAAAATAGAGATTC AAAATCCACTTTCCTACTCCTCTGAGGAC AATGTTTCAGGGTAAACTGGTGGTATTT CCCAGTGGCATGCCCACTTGACAACATG CCCGTTCGATCATTTCCTTTCCTTCTCCA CCACTTGGCCTCCGGCCTGAGAAGGGG CCAGCAATAAGGAATGACAGACAGTAA GGCAATCTTACAATGTCAGAAAATGTAT TTGGCTTTTTTTTCTTTTTAAAATAAGT GCATACAAATACAGCTAGAAGCATTTCT GATTTGCCAAGTGCTCTAAAAAAGCAGC GCAAGTCACAGCCTACATAGAACGGTAA CTGTCACCAGGATAAATAAAGCACAAAGA TATGCTAATAACGTTAACAAAAGAAAAA AATGTCTTTATAAGTACATACCTTTTGTC GTCAAAAAAAATATAGAAACACAATGTA TTCAAAAAAAAATCAAAATTATACAGCCA | 0.000108061 | 0.008100112 | 2.38E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TGTTTATGAAGTCTACATTTCCCTTGTCT TGGATATATATATATGGAGATATATA TACAATTCAAGCAGTTTTAATTAAGGGT AATCATTGGGTTTTTCTGAAACCGGAAA AGTCACGAGTCTCTCTCTTTTTTCACTTT CACATCTCCAGCAAGGATGGTTGCAATT TCCCCTTGCATAAAGGCCCAGGGGACAT TGGAGCCCACAAGAGGGCATTTTTCCCC ACTGGGACAATAGACCTCTCCACTAGCT CCCTGCTGTTTGATGCTTTGTCTGGAGCA AGGGAAGCAGAACTTGTGCGAAGGGAC GGACGGGCACTGCACAAAATGGGTGTCC TCCAGCCGCTCGTGGCAGAGGGTGCAGC ACAGCGGGGCACTGGTTGCCAGAGAGG AGTCCGGGAGGCTGGCAGGGTGCACTGG CTCCAGTCCTCCTGTGTTGCCTGCTCCCT GGCCCCCCACCTCTCTGGGGCCCAGCCT TCTTTGGTTCATA | | | |
| 1678 | 2386782 | 4 | GPR137B | GTCACCAGGCTCACACAATCATTTAAGA AATAAAAACACATACACAAAATGTAG GCTGCCCCTACAATCTAATTTATGATAA AATAAGATGAATTTCAGCCTAAGAATAC TTCATTTATTTTCTTAGTTGTGAAAAAAT TAGTTAAGAACCTTAAAAAGAACTTTTT ACTCTAACCAGATCTTTTAATTTCCTAGA ACATACTCTAATATACTAGTTTTCCTAAG CTTGAAACAAATCACAGTACAGAAAAAA ACAATAAATGGACATGAGCGAGGATTTT CTCCAGTAAACAGTTTAAATAATAGCCT TTAACTGAGGGAGTGGTGAAATAACACT ATCAAAAAGTTCTTTACATTTAGAGTGA TAAACAAAGTGCAGATTTTTCACATCTT AAACTCTGAGTGAATACTAAGAATAATT CTTACTAATTTACTAGTTAAATTAATTGG ATAGTCACTTTTTAGACAGTTTGCCTTAA GGCCCCCCTCCCCCACCATACAATACTT GCAACCCTCAAGAAAAAGTAGAGGAGG CTCCAATCAAGTCA | 0.001757031 | 0.007939934 | 4.07E-06 |
| 1381 | 2389967 | 1 | | GAGGTGATACCAGAGCCTTCGCAACACC AG | 2.60E-06 | 0.008282347 | 6.16E-06 |
| 908 | 2391060 | 4 | C1orf159 | ATGGTGCTGCTAATGTGTCTAGAATTGG | 9.88E-05 | 0.011500656 | 5.14E-06 |
| 825 | 2391846 | 2 | GNB1 | CACTTATTGCTGAAACCAAGAGCACAAT TCCCATTGAGAGAAAGATCTCTGTGCTG TAAACTAAAACAAATTGTGCATTCCTTC CGGGGCCATCGTCTTTG | 0.000128482 | 0.014644576 | 1.14E-05 |
| 529 | 2393322 | 1 | | AGCGCTCTGGCCGAGCACCAGTGTGCCA GCCAGAAAGCACACCTCTATCTGCGGGA GCAGAGCTCCTTTCCTGC | 0.010386073 | 0.008019303 | 4.22E-06 |
| 606 | 2395510 | 9 | ENO1 | TAAGTTTGGTGCGAACGCCATTCTGGGG GTGTCCCTTGCCGTCTGCAAAGCTGGTG CCGTTGAGAAGGGGGTCCCCCTGTACCG CCACATCGCTGACTTGGCTGGCAACTCT GAAGTCATCCTG | 0.000156233 | 0.019298761 | 2.09E-05 |
| 333 | 2396027 | 9 | LZIC | TGACACTCGGAACGTCAAGAACTGGAGG TTTGTGCAATTTGAGACCGGTCGGCACT GTGCAGAGATCAGA | 1.95E-06 | 0.020081931 | 2.37E-05 |
| 348 | 2397591 | 5 | KAZN | GAGCTTGGAGATGATGTGCCCCCTGGTT TTCTCACATACTGCCTCTCAGCTGCAGAG ATGCTGCAGACCGTCATTCACACCTATT TCAACAAGCCGAATACACTGGAGTTTAG | 1.81E-06 | 0.015572111 | 1.63E-05 |
| 695 | 2398901 | 6 | | CTCCCTGAGGTTCCGTTTTACACATGATC CAACGTTAACTACCTTTTTTTCTGTATGC TTTCCAAAGTCCTTTTTTTTCCCTTAATGT TGAATTAAAATACTTGCTCATAGTTGATT TACCATTCCTACAAAAGAGGCAGAAACT TGAGCAATCTAGGTTTTTTTTTTTTTTA AGTTTTTTCTTTCTTCCTCTCCTGAATAC ACTCCCCAAAACACCCCTTTCCAGTTAC AATTAGCATCGTGATCCAAGCAGATGCC ACATGGAAGAGGAATCGCCATTTACTCA | 7.23E-06 | 0.016623913 | 1.75E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GAAAAAATGTCCCTTACAGGAACCGGCA GCAGCTAGGCAGTCACCGGCCCGCCTCC ATCCAAAATCACGCTCGCGTGCTTCGGA AGCATC | | | |
| 1507 | 2399450 | 9 | UBR4 | AAAATCATTAGTTTGGACCTTCCTGTGGC TGAAGTTTACAAGAAAGTCTGGTG | 3.56E-05 | 0.008422828 | 4.92E-06 |
| 1181 | 2400148 | 3 | RP4-749H3.1 | CAGAGAGGGTCCGTGGCATGTCCAAGGT TACTCTG | 0.001221904 | 0.010206572 | 5.86E-06 |
| 152 | 2400178 | 2 | CAMK2N1 | TGTTGGCATTCTTCGCTGATTTGGCTGTT CCCAATGTTTACATTATTTAATCTTGCAA AAATGGTTCTGTGCACTTGGATGTGAAA TGCTGTCCAGTTTTATTTTTTTTATGTTGT TATCCTTGGATGTACAAAAAATTCAGAA AATGATCTCTGTAGATATTCTGTTTTATT TTGGTCATCTTTAGAAGTTATCAGGAAT GTGTTTAAAACAAGAAGAGAACTTTTCT AAGGAATGATACATAGAAAAGATTTTAT TTTAAAATGAGTTGTAAAGCTTGTGTTTC TTTGTTGCTGCAAGCTATCTGCCCAAGTT AATGCAAATGGACACATTTTTTATGTCA GAAAAACACACACACACACACACAC ACACACACACACGAAAAACAAAGAA AAAAATGCTTGAGCTTTTTCTAACTTCCC CTTGCAGTCTGTTGTGTGAGCAGCCTGTT TATTTCTAATATTATGTCAGTTTATTC TCTTTAATGGACTGTAAAAAAATGTAAT CACAAGAGTGCCAAATATCTTGAAATGC CAAAAGGCATTTTAGTTTCTTTTCTCTGT GCTCTGAGTCCACGTACAGGAATGCTTG GAGTGTCTTTTCTGTTATTTATAGGGATT CTCTTAAGGCACACCAGCTGCCTGTTTG CATGGTATTTGCAAAAATGCCTCTTGCGT GAGGAAATCTTTTACC | 9.01E-06 | 0.026063706 | 2.59E-05 |
| 582 | 2400179 | 2 | CAMK2N1 | GAAATTTATTACTAGCTTGCTACCCACG ATGAAATCAACAACCTGTATCTGGTATC AGGCGGGAGACA | 4.47E-05 | 0.01559515 | 9.45E-06 |
| 97 | 2400180 | 2 | CAMK2N1 | GGAGAGAATAAGAACGGCGGTAACAGT TATTGGCAAAAAGC | 3.66E-06 | 0.031824392 | 3.10E-05 |
| 58 | 2400181 | 9 | CAMK2N1 | TTGTTATTGAAGATGATAGGATTGATGA CGTGCTGAAAAATATGACCGACAAGGCA CCTCCTG | 0.000198282 | 0.038963268 | 4.21E-05 |
| 575 | 2400707 | 9 | RAP1GAP | GACAAGTCCTTCACTTCTCGCCGGAGTG TGT | 0.003098917 | 0.010613844 | 6.50E-06 |
| 1813 | 2401703 | 4 | MYOM3; RP11-293P20.3 | CTGCTGGGGTGAAGTTCAAAATCCCTGG CCACTGGTTCGTGCTAGAGATGCTGGAC TGCGGATTAATGGGAACCC | 7.38E-05 | 0.006696158 | 3.40E-06 |
| 1753 | 2402420 | 2 | C1orf135 | GTGGGAAGGTGGCATGGGATGAAGTTGT CATTACTGAGCATCTTCTCTGTGTAAATA AAGGGCAGTACCA | 0.00010346 | 0.009232187 | 3.30E-06 |
| 643 | 2402463 | 2 | STMN1 | GACTGTATAGGTAGATCCAGATCCAGAC TGTAAGATGTTGTTTTAGGGGCTAAAGG GGAGAAACTGAAAGTGTTTTACTCTTTTT CTAAAGTGTTGGTCTTTCTAATGTAGCTA TTTTTCTTGTTGCATCTTTTCTACTTCAGT ACACTTGGTGTACTGGGTTAATGGCTAG TACTGTATT | 2.42E-06 | 0.018080299 | 1.07E-05 |
| 484 | 2402464 | 9 | STMN1 | GCACATTGAAGAAGTGCGGAAGAACAA AGAATCCAAAGACCCTGCTGACGAGACT GAAGCTGA | 0.000363271 | 0.023971946 | 2.62E-05 |
| 1879 | 2402466 | 9 | STMN1 | ATGGCTGCCAAACTGGAACGTTTGCGAG AGAAG | 4.53E-05 | 0.010009361 | 5.91E-06 |
| 1581 | 2406442 | 9 | CLSPN | TGACTCTGGTAATGATCTGGCACTGGAA GACCATGAAGATGATGATGAAGAAGAA CTCCTGAAGCGATCTGAGAAGTTGAA | 0.000150908 | 0.010372461 | 7.04E-06 |
| 1799 | 2406443 | 9 | CLSPN | ATTTGGAGACTTTCGGCTTGTTTCAAATG ATA | 0.000126082 | 0.008736274 | 4.61E-06 |
| 1562 | 2406607 | 3 | TRAPPC3 | GGGCCACCTGTCCATGCTGAAGAATTGC TGCTGAGAGGCACTGCTTACCACTCTTTC TATCTCCCTTAGAGAGGCCTTTAATCTCC CAAAAGACTGGCTAGGCAGCTCTTTGGG | 0.002919457 | 0.007068394 | 3.93E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TCAAAAAAACATTCCAGGTCGTTAGGGA ATAGCATAGATTATTTAATCCCTGTGGAT TAAAGCCCCACTGAAATCAAAGCCTGAG CTTTTCCACTGTGAAGGTG | | | |
| 450 | 2409634 | 4 | ERI3 | TCAGAGCTGAATCTGTGGGCAGAGCTGG CTTGTCTCTAGGAGAGACATGGCACTAG CTGAG | 0.00060261 | 0.008504212 | 4.47E-06 |
| 139 | 2410530 | 2 | POMGNT1 | TGAGACTTAATTACTAACTCCAAGGGGA GGGTTCCCCTGCTCCAACACCCCGTTCCT GAGTTAAAAGTCTATTTATTTACTTCCTT GTTGGAGAAGGGCAGGAGAGTACCTGG GAATCATTACGATCCCTAGCAGCTCATC CTGCCCTTTGAATACCCTCACTTTCCA | 0.004360173 | 0.017748354 | 1.83E-05 |
| 1411 | 2413541 | 4 | HSPB11 | TGGAAGCGCCACTACCAGCCCACGAAAC TCTTTGAGGCCAGAAATAGCGTCTTGAC CCCC | 0.011398396 | 0.006601892 | 4.14E-06 |
| 1011 | 2414409 | 4 | PPAP2B | AGGCTAGGTCAGGTTCTTGAACATCCTT GTGAAATTATTCTTCCCTTAAGTCTGGGT TAAATTATAAATTATGATCTGCATTTAAA TTCCCAAATTTAAAACAAACCAAACAAA ACAACGCACTTCAGACTCTTTTGGAAAC CTTTGAAAGGAACTTGATTTCTGTGTGAT TTGAAAGTATATATTGCAATCAAGGTAT TGGTGGTAAGTGTGTTTTTGAGGTTTGTC ACAAATTAACAAAATTATATGCCTAAAG AGTTTTGCAGAGAAATGCAAATCATTAT AAGCGCCTTGTCATAATAAGTAGTGTGC TTTGGTTCCTGTTTATGTATCCCTAAAAC ACATAATACACTATTACATTGACACGAA GGAAACCATTCTCATTGATGGTTTCTTTA TATCTGGCCCCCAAATTAGTTTGTGGTAT CAATCAGTATAATTTCTAGAGAGCCTAT TAAGCCTATGTTTGTACCTGTCTTTCAGG TATAAGCCTTGTCTTCTGCAGATGATTCT TGAGCACCTACTATATGCCAGGCCCCAG GGTTTCCATGGCCTTAAGGAATTCCCAG GCTGGTGAAAGTGGAACAGGCTTTTGCC TAATGACAAACACTATATAAGTGATGAC TTTGGAGCCTTAAGGGAGGGCCTACTCT AGCAGCACAGTGAAGA | 0.003064934 | 0.007911982 | 5.54E-06 |
| 754 | 2414437 | 5 | PRKAA2 | CTGCATTCCAGCGTTAAACAACACCCCA GGAAGAAAGACTCACAACCTCTGGCCCC TGGAGCATCCCCCAAACAGTCACCCCCA ACAACCGAGAGTCCTGGAACGTGA | 4.32E-05 | 0.011624453 | 7.82E-06 |
| 1378 | 2415125 | 1 | | CCACACTTTGATTAGCAAGGATTTAGAG CCAAGGGGCTTCCATAGCACAGACAATA TTGGATCCACCACCAAAAGGTTACAAAT CA | 1.22E-05 | 0.00685264 | 1.64E-06 |
| 222 | 2415666 | 5 | NFIA | GAAACCAGACTTCTCCGACTTCTTCAGT GTGGTTGGAGATGGCATTCCTGGCAA | 0.013961818 | 0.010182727 | 9.23E-06 |
| 234 | 2420021 | 1 | | GATATAAGCCAAGCTAAGAAGAACAAG GACTCTGTGAAAGGAAAGTCACCTGTTT CTCTGGCCCAAGTGTTCGCCTGTCAATCT GCTGTTCCAGATCCAGACTATAA | 0.022075503 | 0.011356751 | 8.96E-06 |
| 1362 | 2423947 | 3 | RP11-86H7.6 | GAACAGAATTTACACTCAGCCCTGGTAA CCAGTCTATCCGTCAGTACCAG | 0.000333103 | 0.006732521 | 4.49E-06 |
| 544 | 2423977 | 1 | | TCTGCTTATATTACAGAGGGGAGCTGGG GTGAAGGCTGGGGGGAGCCAGCAGGAC GAGTTCTGAAGCCTCTTATT | 0.002202047 | 0.009340892 | 1.02E-05 |
| 203 | 2425002 | 5 | PALMD | TGGGCCTTTTCGTTGTTCTTCAGTGTGGG CCACGTTCACTTTCAGACAGTAACTCGT AGGGATAACTCTGTCAGTGGTACGTTCA GTCCTTCATCTCACGCTTCTTCATCTCAC TCTTCTCGAGAATGCTGGAGTCATTGGT ATCCTCAGTTCCA | 0.001460097 | 0.011648419 | 1.24E-05 |
| 708 | 2425301 | 5 | CDC14A | GGGCATCTCTGAACTTCCAATCTGAAGT AGCCAGCCAGTCACCAGCACATCACCAA CTTGCCATTATCACTGACCTCTTATTTGT TTGTTTCTCCCAGCAAAATCTAAGCTCTG TCAGGACAGGGATTTTCTCTCTCTTGTCC | 0.028404922 | 0.006591512 | 4.33E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | ATTACCATATCCTTAGAGCTCAGAAGGG GTGTCTGGCCCAGGTGCTCAATGACTGT TTGTTCAATGAAAGAATGAACAAATGAA TCACACAAAAGGAGAGAGGAAAATACT ATTTCCCATTAAAATGAAGAAAGAGTTT TTATTAGAAGGGAAGGCCACAGCAGCCC TCTACTACCCTCTTTTGACTAAACTTCCA GGAAATTCATTACTAAGTTTTGGGCTTCA GTAAGTCAGAGTCAATTT | | | |
| 1886 | 2425955 | 7 | AMY2B; ACTG1P4 | TGTGGCAGTGGCCATCTACTGCTCAAAG TCCAGGGCAACATAGCACAGTTTCTCCT TGACGTAGTGTCTGATCTCCCGCTCGGC AG | 0.000731459 | 0.007223839 | 4.52E-06 |
| 1256 | 2428116 | 2 | KCND3 | TGTTATGACCCATGACCCTCGGAGCCCA AACAGCACCATGAAGAGCATCATTAAAA CTAAGAGAAAGTGGCTATCAGAAAATGA AACAGCTTTAAAGGGGTTCCTTTTAGT CTTGTTTTCTATTCAGAATGTTCTGTGTT TTTTCTCAAGTGTGGGAATGACATTTATC TTAGCAGGTTACTCAACTACACTGGATG ATGTCACTCTAACCAGTGTACGGCACTG ACCCAAGTCCTGGGGGGCTCCTTGGACC AATGGACTATTTTACAAACCTGGGAGGT GGGAGGGATGGTATATTTTTGATAATCA GACATTCCAATGTAATGTTTTCCTTAGAG GTCACACCCTTCCCCCCATTAATGTCATC GTGAGATACATCAAGTGTGTTCTTTTCTA TTTTCGTATAATAAATGGGCTTTGCTTAT CAACATCACAATGGCAAAGAAGAAATAT ACTGTACAAAACTGCAGGAAGATAAAAC ATGAAAACTTTCTATGAAAAAAAAAAAA CACCCTTGAGTTTCCTGTCGTCTTC | 0.003923309 | 0.00762346 | 5.07E-06 |
| 866 | 2428148 | 4 | KCND3 | CCAGAAACTTCTTACCCGTATTGAGCTG CCAGAAGCTGCAAGTGCTGTTGCAAGAT G | 0.000333956 | 0.00838534 | 4.70E-06 |
| 1653 | 2428490 | 6 | | AATGCTTTGTCTGCCTTATTTGTCAATGA GCTCCACCCTGAACTCAATAATCTGGTT AAAAGCAAAAGCTAAATTGGAAAGTTCC TAACTAAATTAGTAAACTCAACACTTCA GGATCTTTGTTA | 1.05E-05 | 0.006690888 | 3.07E-06 |
| 1030 | 2428505 | 2 | SLC16A1 | TCCATGGGGCTGAAGGGTAAATTGAGCA GTTCATGACCCAGGATATCTGAAAATAT TCTACTGGCCTGTAATCTACCAGTGGTGC TCAATGCAAATAGTAGACATTTGTGTGG AAATCATACCAGTTGTTCATTGATGGGA TTTTTGTTTGACTCCTTACCAATAGCCTG AATTTGAGGAGGGAATGATTGGTAGCAA AGGATGGGGAAAGAAGTAGGTTCTGTT TTGTTTTGTTTTAATCTTAGCTTTTAATA GTGTCATAAAGATTATAATATGTGCCTT AAGTTTTAGTCTTTAGAACTCTAGAGAG CCTTAACTTCTTAAACCATTTTTGCTGAA TTCATCTATTTCGAGTGTTGTGTTAAAAG GAAAAATAACAACTAACTTGTTTGAGGC AAATCTAAAATTTAAATTAATCTTGCTT CATTGTTACATGTAATATATTTCAGACAT TTTCACTGGAAGATTTATGAACAGAAAT ATTGGTTGAAAGTTAGAGATTTTACAAA ATGCTGACAAAAATATTTTCCTAGCATC AGTAGATTTCTGGCATATGTTTCTGCTAG CTATA | 8.27E-06 | 0.012777404 | 7.84E-06 |
| 1824 | 2428507 | 9 | SLC16A1 | GTATCTATCTCTTCATTGGCATGGGCATC AATTATCGACTTTTGGCAAAAGAACAGA AAGCAAACGAGCAGAA | 0.000131632 | 0.007514531 | 2.97E-06 |
| 536 | 2431143 | 9 | NOTCH2 | AGCGGTGTACCATTGACATTGACGAGTG TATCTCCAAGCCCTGCATGAACCATGGT CTCTGCCATAACACCCAGGGCAGCTACA TGTGTGAATGTCCACCAGGCTTCAGTG | 3.08E-05 | 0.012700774 | 8.14E-06 |
| 1737 | 2432473 | 6 | | TCCGCGCGGAGGGATCTACTACGAGTCA CTGGCCCCGTCCGCATCCTTCTCCAGCGG | 5.28E-06 | 0.007929227 | 4.32E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CCCCGGGGGCCGCCGCGCCTTAACTCGATCAGG | | | |
| 1109 | 2432882 | 6 | | GCCATAGGCCCTGATGACCCAAAACCCCAGGCTTATGAGAGGCTCCAGACCTCCATACTTTCACAATGACAGTTGTATCAATGGTGTTTTTTCCACTAAGCTTATGTGGCCATGACATGACCAGGACTTCCTGGGTAAGAACGGAGATGGGAAACCCATG | 0.002356255 | 0.006664499 | 3.11E-06 |
| 699 | 2433254 | 2 | FMO5 | GCGACACTAACAGGTGAAGATCTCGGGAGACC | 0.00580501 | 0.009377878 | 2.79E-06 |
| 1560 | 2433880 | 4 | RP11-744H18.2 | TCCCAATGGAACACCCATGACGACTCATGAGG | 0.000454879 | 0.006744412 | 3.44E-06 |
| 964 | 2434001 | 6 | | CCCCGGCTGCTCTTTTTTATAGACGAAGAAATTGAGGTACAGAAAATCCAGTAACGTTTTAAAAGTCACGTCATGAATGAACCAGATTTCAACCCAGAAATTGAGGCTTCACTACAAGTGAAGACTGGGGTTTTCTTGTTTTCAATTATTGGGAGTTTTGGATTTCCAGGAATGTGCAATTGTAAAAACCCAGCTTCAGGAGGTGATGAAATAGGTGCAGTGGCTCTGGCGTAAGCTCTGAAGCCCCAGGCTCAGGCTCTATTGAAAAATTACTTTTGCTGAAATATTCCTGTTTTTAGGAACTTCCATGGAACTTGAGCCTTCACGCAGCATATTTTGGCATCTGATTCAAAGCTAATAGAGGTCCGGAGGATTCCCAGGATTAAAGTCTTTAAACAGAAACTGTGAATCTTGCCTAAGCAAAAGGTGCCATCCCTGGATGGGCTTGCACCACCAACCTTTCAGT | 3.58E-06 | 0.013245904 | 1.02E-05 |
| 1858 | 2434095 | 1 | | TCGTTGGGACACTGAAGGGAGATCCAGAGTTCCGACTGAAATTTGAGAAGCTCTTTGCTATTCAAGTGGATATGTGCAGTTGACAGTTTGAGAGATGCATCTAGGGTTCAGTAAAGACAACACAAGCCTGTCTTTAGGGTCTACCTGTGAACTGTGAACACAGCAATGAGAATGATGGACATCACCTTTAAGTATTTTTCTAGACTTTATTACTCATGTGTTTGTCATGAGGTGTAACTTAGTAGTTCATAGTCCTATAATGTATGTTATTGACTAGGTAGCATTTATTTTTCTAATTGTTTCTGTTATAGTGCTGCCACATGTGTTTCCCAGAAACGCATTTTACCCACAGTTCTTAGGGTTGGCCTGATTAGTTTAATTGCTGTCTGAACCTGCTTCTTACTG | 0.001705241 | 0.006866301 | 4.85E-06 |
| 1432 | 2434340 | 5 | CA14; snoU13.115; CA14 | TGTCCCTCAGAGATTGGCCTTATCCCCCCAGCATGACTTTTCCTAAGGTCCAGATCCTTTCCCCAGGACCACCCATCCCTGTTACTTTGTCTGAGTCCCAGCTCTTTGTTCCCTGGTACCTCTGCAAATGTGGCTTCACTGTTGATCTGGTGTTCTGACCCCCCTGGGGATCCTTTCTGACCCCAGTGCAGGTGGAGCTGGGCAGCTACATATTTTCGGGGAAGTCCACCCAGATACAGGGTAGAGGGCAGAGAGAGTTGCACTGTGAGGAAAAGAGCAAACTCGGATTGGTGGAGGCATGTGGATACATTCCCACTCCTGGGTTGCCACCACTTCTTGGAGACTTGGCCCTCTTCCAGTTTTCTCCCCCAGTAGCACCCAGTTCCTCCCATAGGCCAGTGCTTTTCTAGCATATCTTCCTTTTTCTTGGTGAAGACCAAGTCAGTGCAATGATACCTACCTACTGAGCTTGGTTATAAACATTTCGATTCCCGCTTTGGCTACAGGATCCTGATCCCCATTCTCATATCTCCAAATTCATGGACAAAGGTTTTTGAGAATTCGTAGGTTAGGAAAATGCTGCTTTCCTCTGACTCCTGAGGTTATTTGTTTGTTTATTTATGTCAGATGGGTAATGTGCCAACATCTTGACAAGATTTGAGGGCGGCACATC | 0.008706715 | 0.006743011 | 5.10E-06 |
| 1647 | 2435365 | 4 | THEM4 | GTTGGTCTCGCTTCCTATCTCACTAAGAGAAAATAAAAGCAGTCAGAAGAGAACTC | 6.81E-05 | 0.006800674 | 2.64E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CCAGTCTCCCATTGCCTCACATATCCTCC CCCCTGCATCTGTGCCTGATGTTCTGCTT CTTCCTGCTGTGAGTGAACCATCCACACT CTTAGGGAGACCAAGCCTTCCATTTGTG CGCTGCATTCCATTTTCTTTGGCCTACTG AAGGACATCCATCTCTGCTAGATGTTTC GTATCAGCATATAAACATGCCACAACTG CATTTCTCTCTTCCCAGTCTCTCTCTCT CTCTCTTTTGTTTTGGGTTTTTTTGTTTTG TTGTTTTTTTGTTTTTTTGTTTTTGGTTTT GAGAATGAGTCTCACTGAGTCACTCAGG CTGGAATGCAGTGGCGTGACCTCGGCTC ACTGCAACCTCCTCCTCCCGGGTTCAAGT GATTCTCCCACCTCAACCTCTCAAGTAGC TGGGATTACAGGTGCATGCCACCACACC CAGCTTATTTTTATATTTTTAATAGAGAC AGGGTTTCACAATGTTGGCCGGGCTGGT CTCGAACTCCTAAATTCAAGTGATCTGC CCCACCTTGGCCTCCCAAAGTGCGGGGA TTACAGGCATGAGCCACTGTGCCCAGCC TATCTTGAACCCACTCCCTCAAAACAGC TCTTGCCAAAGGTACCAGTGACCTTCAT GTTGCTGAGTCCGCTAACCTCTCAGCTTT TGGCACAGCTGTTGACTCCTTTC | | | |
| 2045 | 2435391 | 2 | S100A10 | GCAGAAATGAGCAGTTCGCTCCTCCCTG ATAAGAGTTGTCCCAAAGGGTCGCTTAA GGAATCTGCCCCACAGCTTCCCCATAG AAGGATTTCATGAGCAGATCAGGACACT TAGCAAATGTA | 2.12E-05 | 0.007179441 | 6.15E-06 |
| 138 | 2435392 | 9 | S100A10 | TCTTTTCCCTAATTGCGGGCCTCACCATT GCATGCA | 1.64E-06 | 0.029375761 | 3.58E-05 |
| 420 | 2436400 | 5 | CREB3L4 | CCAGCCACGCGTCCAGCAGGTCAGGGAT T | 0.010140998 | 0.009145342 | 7.79E-06 |
| 2046 | 2436718 | 2 | UBE2Q1 | TGCTGTATTTGGATCTCACGCTGCCTCTG TGGTTCCCTCCCTCATTTTTCCTGGACGT GATAGCTCTGCCTATTGCAGGACAATGA TGGCTATTCTAAACGCTAAGGAAAAAAA ACAAACACAGAACTGTTTCAAGTACTCA AGACTGACTTACAGACCAACCAACCACC TTGCTGGAACCCTTGCTAGCAGGCATTCT TATAAAAGAAACTTTCGAGCCTCCTTAT ATTGCTGGAAACTCAGCTGTGCTCCAGA CTAGAGCCTCCTTACCTATGCTATGGA | 1.24E-05 | 0.008826572 | 5.71E-06 |
| 1559 | 2436760 | 9 | ADAR | TCCAAAAGGCAATCCGGGAAGACTAAG GAGACAAGCGTCAACTGGTGTCTGGCTG ATGGCTATGACCTGGAGATCCTGGACGG TACCAGAGGCACTGTG | 0.000333103 | 0.007188607 | 4.31E-06 |
| 2081 | 2436777 | 9 | ADAR | TTTTCTGGGAAGAGCCCCGTCACCACAC TGCTTGAGTGTATGCACAAATTGGGGAA CTCCTGCGA | 0.00055537 | 0.006511312 | 3.94E-06 |
| 1816 | 2438283 | 2 | IQGAP3 | GACTCTTCCAGGCAATTTCCATAGATCTG CAGTCCTGCCTCTGCCACAGTCTCTCTGT TGTCCCCACATCTACCCAACTTCCTGTAC TGTTGCCCTTCTGATGTTAA | 0.019281916 | 0.007219209 | 5.36E-06 |
| 1403 | 2438403 | 4 | RP11-284F21.7 | GATGCGCGCCGTACATCCGGCACTGGGT CTCTGCCTCCTCCCAGCTCCTTCGTGTGG AAAAGTGCTTGTAGCAGGCGCCCT | 0.009861702 | 0.007020494 | 4.83E-06 |
| 702 | 2439112 | 9 | FCRL1 | ATCATCTTACCTCAGGAGTCATTGAGGG GCTGCTCAGCACCCTTGGTCCAGCCACC GTGGCCTTATTATTTTGCTACGGCCTCAA AAGA | 0.00180613 | 0.010454141 | 6.09E-06 |
| 697 | 2439713 | 1 | | ATCCATGGATCTGCTGCCAGGTTCAGTG ACTGGAATGCACTTGCCCCAGCGGGTTC AAGTTCTTTGTAGAAACAGACCCCTCAA AGATGACAGCAGCTGGCTTCCTCCAGAA GTGTCCTTCAACACTGTCTTTCAGTACTA AGTGACCAGTAGAAGTTACTCCATAAAG ACCATAGCCAGGAATGAATTATGGGGCT TCCTGCATATCAAATGGTTACCTAGGGA AGGCATATGGTAAACTAGTTAAGCACAG | 0.018818925 | 0.009054474 | 6.05E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AGGTTCTGGAATCAGACTGCCTAGGTCC AAATCCTGGCTTTACAACTTACTAGCTAT GTGACCTTAGGTGATATAACCTCTTTACG CCTCAGTTTTCTTACCTACAAAGCAGGA GAAATAATAGTAATTAGCTCAAAGGGTT GCTATAAGAATCAAAGAAAATCATGCAA GCAAAGCACTTACTACAGTGCCTGGCAC ATAGTAAGCTCTTATAACAGTTTTCTGGT ATTATTCTTATTAAGCCATTTTGTATTAT ATCCATAAATGTAGATTCATAAAATACA TAAAAATACAACTTGGTAGAATTTGTCT TGGTTGGCAGCAGTTGAAGCTTCT | | | |
| 713 | 2440486 | 9 | F11R | ATTCAAACAGACCTCGTCATTCCTGGTGT G | 0.002951948 | 0.009184105 | 4.04E-06 |
| 1854 | 2440934 | 6 | | CTGGTAATTGGGCTCTTTGTTCTTCTGGA GCTTCCGACTGCATAAGCAGTGAATAGG TGATTTTGTTCTCAGCATGGAGAAGGCA GAAACCAGCAGTAGGGATCCACAGAGA GGGCATAGGAAAGAAGATGTTAAAGAG GCTGGACATTGGGGCTGATGCTGGTCAT CC | 0.000329714 | 0.009574997 | 9.06E-06 |
| 1880 | 2441254 | 7 | UHMK1 | CATGATGTGATTCCAATGTACCCGAATC TGAATAAAGCCACCTAGCATGTACCCCT GCATAAGTGTCTAGGTAAATAGATGGTT ACTGAGTGTCTCCC | 0.000674778 | 0.007808112 | 7.85E-06 |
| 479 | 2441293 | 1 | | TGGAAAGAGATCATGGAGGAACGTTCCC ATA | 0.04486637 | 0.007065833 | 3.64E-06 |
| 52 | 2442609 | 9 | CD247 | CACCAAGGACACCTACGACGCCCTTCAC ATGCAGGCCCTGCCC | 1.32E-08 | 0.058186499 | 7.57E-05 |
| 146 | 2442711 | 4 | CREG1 | GTACTTACACATCTTTCACCTAAGATTGC CGCCCTTACAGCCATCCTCAGCCTTCTAA GGCAAGGGGGTTTAACCGTTTCATGTG CCCTGGACACCCTGGGCAGTCTGGTAAA GCCGCTGAC | 0.044564191 | 0.016459758 | 1.51E-05 |
| 1139 | 2443145 | 2 | DPT | GGAGGCAGAGCTGAAAACAGGGTTGGA AGGA | 0.001689593 | 0.008816218 | 5.73E-06 |
| 1553 | 2445386 | 9 | ASTN1 | CCCAAGGTGCTGACATTCCCAGAATACA TCACCAGCTTGTCAGACTCCGGCACCAA GCACATGGCGGCTGGAGTCCGCATGGAG TGCCACAGCAAGGGACGATGCCCCTCGT CCTGCCCCCTGTGTCATGTGACATCCAGC CCTGACACCCCTGCTGAGCCGGTTCTGCT GGAGGTGACCAAAGCAGCCCCCATCTAT GAACTAGTGACCAACA | 0.00081399 | 0.007829511 | 7.28E-06 |
| 201 | 2445439 | 4 | ASTN1 | TGCAGGGCACACTCTGTCTGGCTGGGCT CTCCTCCGTACCATGACACGTCTCTCCGT TGGAGTCCTATGTACACCACCATGGAGT CGGCGCCTCATG | 0.000986793 | 0.015663776 | 1.28E-05 |
| 1306 | 2445596 | 1 | | AGGCACGCATGCAAGGCCTGCCTGCCGT GCCTCCCTCTGCCAAAGGCATTTTTAGCA ATTTCCTAAAAATGTGGCTACAATGGAA AATGAAGCTGTTCAGGGGGAGAAGTGAT GGCCCCGAAATGCATCCAACAGCC | 2.37E-05 | 0.008143377 | 5.57E-06 |
| 1045 | 2445659 | 4 | AL359075.1; SEC16B | TTCAGTACAATATGATCCTGAGACAACA GTCCCACTGCCTT | 2.89E-05 | 0.008115986 | 5.64E-06 |
| 2059 | 2446213 | 2 | TOR1AIP2 | CTTATTTCCTGGGTCCATGGGAAGCATG AGTCTGTTGGGACTTGGGACAAGAAGAA AACAAGACATCTTCACAAGGAAAACCAA GTACTAAAAAAAGTATCCTCCCAACTCT GAAGAGATAGAACACAAA | 0.000701725 | 0.006905728 | 3.97E-06 |
| 1017 | 2449595 | 9 | ASPM | TGGCTTTTTCACGAGATTTCCTAAGTGGT GAAGGTGACCTTTCCCGTCACCTTGGCTT ATTGGGATTACCTGTTAACCATGTTCAG ACACCATTTGATGAATTTGATTTTGCCGT TACAAATCTTGCCGTAGACTTGCAATGT GGAGTGCGCCTTG | 0.00028481 | 0.011214528 | 1.13E-05 |
| 1479 | 2450707 | 7 | IGFN1 | ACACACACGACCTTGATGCCCTAGTCCT CACCCAGGTCCTCTGACCTCCTCTCCTCT TCCCTCCCAGTGGTCACAGCAGGCCCAG CTGTGCCCACCCTCCCTCCAAACGGCTC | 0.008126841 | 0.006840666 | 3.17E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1990 | 2452640 | 2 | NUCKS1 | AGCCCAGGAAAATAAGGAGCCGGCCCA TC GCCAGGTTAAGCAACAGCCAAGTTCTCA GTAATTGTTTGCCTTGATTTATCTTTTAG ACTTCATTTTGCCAGCTCTAAAACTCCCA GTCTTCCTTGATTTTAGTCCTTAATCTTTT ATGTTCTGAGCAGGAAGGGTAAAAGACA GGAACCTGCTTCACTGTATTAACTAGTCC ATGGGCTGAGACCGGGGCATCTCTTTTC TT | 6.19E-05 | 0.006513548 | 4.46E-06 |
| 1907 | 2452665 | 9 | NUCKS1 | AAAGAGCAGCGGAGTTTGAGAAGCCAG CAGCTCGGGGTTCGGCAGCAGCGGTCCC ATCGGCTGAAGTTCGGGGGGGTGGGGC GCCGAGCGCGCGGGGTGGGGGGGGTCCT GGTCTTTGGCTTCTCGACTCGGTCCTGTT TCGACAGCGAA | 1.22E-05 | 0.00700385 | 2.12E-06 |
| 226 | 2453257 | 3 | C1orf132 | CGGGGAATCCTCAGACGTCTCCATTCAG AATCTCCCAAACGATTGTTCTCTTTTTTG CATTCTTCTCCTTCTGGCTTTTCTGTGTG GGGTTAGTAACCAGCACAGGGTTGGGGG CAGAATGGGCAGCTGAAGTGGTCGGGCT GTGCGGACGTGTGGGAGATAGCTGGGTA GTGTTGCTGGGTGTGGCAGTTGGCAGAG CATTTGGGCCTCCCACAGTAATAGAAAC TCTCTTTGGCTCCAGCATCCAGCAGGAG GTTCTGGGTTTAACCCCTCGGTAATCCTG GGAGCCTTCCTGGTGCCTGGGGATTCTCT CCCCTGTGTAGTCTCAGTGGATGGCCTGT CTTAACTCTAGATACATTTTGCCTTGAGG GGGCTTAGTCTAGGTTGGTGGTCTGGAG TTTGGACTGGGCTGAGCAGTGAGCTTTG GGACTCTCCCTAATTTTGGGGTTTCTTTG AATGAGCCACTTTCTTCCTCTAGGCCTTC ATTACCTTTGCCTTAAAAAACAAAATCC CTGGTCCAGTAAGCCATTGCAAAGCATC TCTAGGAAGTTGACAAAGAAATGCTTTT CTTCTGCCTCACTTGCTGCCGATCACAGT AATAGCAATGGTGATTAAAAATGAAAAA TGATGACGGCCTGCAGAATCAGGGAGGT CAGTGGCATCATTGATACAATTCACAAA GCAGACTCTCGGTGCCCACACATCACTA GGAAGTCTCTCTCCTATCGAGTAGATGA CTACAGCATTCTTGGCCAGTAAAGCCAG TTGGAATTAGCCAACAGCAGATTGGTCT GGGCTCTAAAGATAAAAGGAATTATGTT GGGTAATTTTCGGAGGTACCTATGGGAT CCTACCTCTGGCCACACAGTGGTCGCCT CTCTCTGCTCATATGTTTCGGTGGGGGTG GGGGGTTCCTCTTCCCCATGCTGCTCCCG TTGCTATCCAGGGAAGATTGGCCAATTC TGCTTCCTGTTATTTCTTCTTCCTCTGT CCATTTGAGGTGAGTCTCTAGGTTGGCT GTGAACAGCCTGAGGAACCCAGGGCTGT TTGGAAGAATCTGATGTCTCTTCCTTCAA GGACCCTGACAGGTCTCAGCCCTCCAGC AGTACTGCAGTGAGGGATGGCAGGGGGT GTTGGAGTGGAGAGATATCGACTTGGGT GCAGCTGGGGAGACTAAAAGGAGTGAG CCAAGTCCCTCAAGAAGTGTTGGCTAGA GTCTGGCCAGCCCTGGCTGTAGGGCTGG AGCCAGACGTAGCTGCTGGCTGTGCTTG GGAGTCTCAGCCCTCATATGTGCAGTGT GTCCCTGGGCATGGCTCTTCGTGATCCCC ACTCCCACGAATAGCCCTGTCCTTGGTTA GATTGGGAAAACCAGGGTGGGAAGTAA AGGGGAGGTTGGTTTTGCTCGTGGTCAT GCAGTTATCTCTGGCCTCTGATGTTTC CAGAATTGGGATTGGTGCTTCCCTGCTG ATTTTCCTATTTTTGTCCCTCATCTGGTTC TTTTCCTCCTTGCTCACCAGCCTGGGTTC | 0.003864295 | 0.015604689 | 1.46E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TACACACATGACATGGGGCATTGTGTGT TCCCAATGAGGATAGCAGAACAGTTGGT ATCTCCTGAGAGAGGGGCCAGCATATCT GGCACTTTTTTCTTGACCTTTGAATTTCT GAGGTCTGGGAGTCAGGAGGCAGCATG GGGCCTCTCCATCCGGGATCCAGCAGAG GTTAACAGAGTTGGTGGCTCTGGAGCTG AGGTGGTGTGGCTTGGCTGGGAGTTGTG GGGGAGAGGCCCTGCCAGGGGCCCTGAT TGGTCAGTACCTTCTCTATTCCATTGAAT CCTGGTCCGGTCAGCTCTGTGAATTGTTT AATGCATATCTTGGCTCTGTCCCCTGGCT CGAGTGTCCCTAAGGCTGCAGCCACAGC TTTAGAGAGGATCTGTACCTTGTGCTGGT CACTTTTTTGGGCGTGTTACCTCCCTCT GAGATATGTAAGAGATACCACCCTTTCC CACCAGCCGGCTGTCTGTGGGAGGCCCT CATTTTGCTTTGCTTTTCTGAGACTTGGA GTGACTGTGAGGAAAGCATGGACTGAGT TTGCTTTCTTGCTGGTTCCTTCCACAAGA GCTGCTCATGGGCTGATAAAGCCAGAGA ACACCTCCAGGGCCCCATGGCCTGTGCG GAGCCTGGTACCATAGTGTCAAGCCTA | | | |
| 856 | 2454934 | 7 | VASH2 | AGTCCTCCCTTAGTTTGATTCTTGGCATC CTTCAGAAGAATCAAAGCCTGCCTCAGT TTAAAAATCAGATGAAATGTGAACAGAA AGGTTTTTTGGTTCTGAAGACCTGCTGAT CACTCCTGGTCTCTGCCTGAGTGTGTTAA TGTCAGAGGTAAATCCAGTACCGCTAAA TTTGTATAATAGTACGTGACCTCTTGTGC | 9.17E-05 | 0.01002888 | 5.93E-06 |
| 1742 | 2455571 | 5 | CENPF | GGCATCAAGAATCACTAGCTCCTGGTTT TCTTCTGACATCTGCAATTCCCTTTCAAG GTTCTCAACTTTATCCTTAAGTGAATCAT TCTCCCGCTCGCGTTCTTTCAGTTTCTCT GCGATGTGCAGCTGCTTCTTTTCATCGGC CTCAATGCGAACTCTCAGTTTCTCGATGC CTCTTCTCAGCTGATGCACTTCCTCCTGT GTTGAGCTCAGCCTC | 0.000909538 | 0.012399382 | 9.59E-06 |
| 1382 | 2455740 | 9 | USH2A | TGAGGACATTGCAAGCACCTCCAGAAGG TCTCTCTCCACCTGTGATATCCTATGTTT CTATGAATCCC | 6.92E-05 | 0.008670255 | 3.56E-06 |
| 367 | 2458002 | 4 | PARP1 | CTTCATTCTTGAGTAGGGACTTATTGTAT CATCCATCACAAAATCATACAGTACTTTT ATCCAGGAATTGTAGTGAGGGAGGTTGT CATAGTATTCAGCTGCTATTTTCCTCACC TAGAAGGGAAAAAATACAGCAAGATGA AAAATGAGTGTTACTAGGTTCTTTCAAA GATGACTGATGAATGGTTGACACAAACA CTGAGAAGGGAAACCATGAGACCTGCCT CC | 8.76E-05 | 0.022724911 | 2.24E-05 |
| 494 | 2458051 | 9 | PARP1; NVL | GAGAGTGATATGAAACGGAAAGGCAAG CTAA | 0.000839994 | 0.018192256 | 2.19E-05 |
| 614 | 2458059 | 9 | PARP1; NVL | TTTAGCATAATTAGTAGTGAGAAGGAAC TTAAGAATTTAACAGAATTAGAAGATGA ACATTTGGCAAAAAGGGCAAGACAAGG TGA | 0.001013073 | 0.018177128 | 2.33E-05 |
| 772 | 2458061 | 9 | PARP1; NVL | ATATGTGGACATTGGAGTCTTAGCGTCT GATTTACAAAGAGTG | 0.000120755 | 0.016719436 | 1.39E-05 |
| 371 | 2460770 | 7 | RP5- 865N13.2 | GGAAATGCAGGGCATCTCCGCCACTGGG AGTGACC | 0.030881616 | 0.013148273 | 1.70E-05 |
| 240 | 2461554 | 1 | | CTTGCTTCAGGCTTGTGAATTCCTAGAC CAACCCTACCCAAAGACTTCCTTCACCA ACATATTTTCTTTCTAGATAATAGGCAC AAAAACCATTTAGAAGTTTGAGATGGAA ATCATGCAATGCACTCTGCTCTTTATATA TGTTACTGAGGAATCTGGAAGCTTTTCC GGGTTGAAATGCAATTCCTAGGAAATTA TTCTTGCTCTTTTCCTGTGGCTGTTTTAA CACAGCAGCAATGCAATTCAGTGGCTC TGCTCCTTCACAAAGACCTTTGAGAGGG | A 1.71E-05 | 0.015540624 | 6.99E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 647 | 2461808 | 3 | ARID4B | AACTATGCTGAGAGATGCAAATTCAAGG TTTTCTGAAAACACCTCAGAATTGTCCA GTTCTGCCCCCAGATAAAACCACTAGAA TAAAGGTCAGGAAATCTCCAGATGTTCT TGGGACTTGCGCAGTCATCTCAGGTA TATGTAGGGGTTTGGAGCAACCAACTGT CCAGGCACTGCTTTCCTCAGACAACCGT GTCAAACTGATTTTCAAGCCTGACTAAC TTGT | 1.85E-05 | 0.009733544 | 4.19E-06 |
| 1888 | 2461983 | 2 | GNG4 | ACAGGGGGCCGAGCAGAAGCCCCCAGC GTCCAGGGCCGGGGAGGGTCCGCCTGG GCCCCCAGGCCCGCGTGGTCGGGCCCTG CAGGGCGGGAGGCGCGGCGCGGGGCGG GGCCGGTGACGGGACGCGGAGACCCCG CGGGCCGCGGGAGGGGCACGAGGCGCG CGTTTGCACCCGAG | 2.45E-05 | 0.006679482 | 3.66E-06 |
| 987 | 2462132 | 4 | LYST | ACCTTCATTCCAGAGGCATCCTGCCCTGT ATCCGGGAAGAAGGAATGCTGCACACA GATGCCAAGAAGAATCGGAACAGACAG GCATTGCTGGATCCCCCCTCGGTCTATTA CCACGAGATCAAACTCTTTTGTCCAATC ACATGTCTACAGTGCTGTCCATTCTTCA | 0.005853836 | 0.008761152 | 3.61E-06 |
| 646 | 2462390 | 5 | EDARADD | TACTCAACTGCTCTCTCGGCACAGAGCT CCTGGCGAGCGCACCCAGCTGTGCTTAG CGCTGCTGCTTCCAACACGCCAAAGAGC TCATCTTGCCATAGTGGGTTTAATGTCC | 0.009608615 | 0.008062889 | 5.07E-06 |
| 391 | 2462402 | 6 | | CACCGGGACTGGCAAGATGACTTTGGAG TTGCCAGACAAGTCGGCGATGTGGTGGT ACAGGGGAACCCCCTTCTCAACAGCACT AGCTTTGCAGGCAGCGAGGGACACTCCC AGAATGGCATTTGCACCAAATTTAGATT TATTTTCTGTTCCATCCATCTCTATCATA AGTTTGTCAATCTTCTCTTGTTCTGTGAC GTTCAGTTTCTTGCTAACCAGGACAGGT GCAATAGTTTTATTGATGGGCTCAACAG GCTTTGAGACACCCTTCCCCATATAGCG AGTCTTATCATTGTCCTGGAGCTCTAGGA CCTCATAGATACCAGTTGAAGCACCACT GGGCACAGCAGCTCTGAAGAGACCTTCT GAGGGTGAAGAGATCAACCTCAACAGTGG GATTCCCACGAGAGTCAAAGAGCTCCCT GGCATGGATCTTGAGAATA | 0.024995647 | 0.013921384 | 1.34E-05 |
| 148 | 2463199 | 4 | GREM2 | TTAGCTTTACCAGTTGAAATCCATCACAC TTCAAAGCCCAAATGCTACGCCTTCAAG CTCTGA | 5.31E-05 | 0.020014135 | 1.68E-05 |
| 1688 | 2463907 | 6 | | GTCCCAGTTTCCATGGTCAGCCTTACGTC CCATTACCAGTTGTTTGAGTGGTCTCTCC CAATGCATCCCCATAAATTATGCTAATT CCTGCCTGCTCTTT | 3.87E-05 | 0.009135293 | 5.78E-06 |
| 480 | 2464645 | 5 | KIF26B | GAGAAACATCGAAAGCGCAGCCTGCAG CCG | 0.000394997 | 0.01015051 | 6.15E-06 |
| 1745 | 2464725 | 5 | KIF26B | GCTGCACAATTAGAGCCAGCCCACAGGC TGTGACTGGCTATGAACTTCTCTGTCATT TTTGGGCTGCCAAACTTAAACACCCTTTC GACAAAGCTCTTCAGTCTGCTTTCCCTCT TCAGTGCACCCTAAGTCCTGCTGACATG GAAGTCATGAGATCTTCCCTGGAGAGTG ACCTGGCCCCACAGGGGACTTTGCATAA ACCA | 0.02996467 | 0.007436111 | 2.41E-06 |
| 961 | 2465112 | 4 | SMYD3 | CGGTTTTCCTGCCACATGATGCTGACGG ACCTCAGCCTCTCCCGGCCTTGGTGCAC ATACAACAGCCTGTAAAAGCTCCACTTT CTATTCCAGATTGCTGTTATGCGTCTGCT TCTCATTCAAAGGAAATAAGAGGAGATG TAAATCGTCGCTGTGCAGTTACGTGTTTA ATGAAAATGATCTTGCATGCTAGATTCA CGTCCAGGAGCGAGTCGCCCTTACTGCT GGTATTGAACTCACTCTCCTTGGAGCGC CCCAAGGCTGTGGGCTGTGGGGGGGCAT | 0.000740426 | 0.00859054 | 3.68E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1228 | 2468077 | 1 | | TAGTGTGTGTGGGCGCAGCTATTATTTGT ACCAGGA AGGTGAAGTTCACAAGGCCAGTGCCTGC TTCCATGGTGCCTACTGCCAGGCCTGCTA TTGCCTTTGAGATCTGACTCAGAACACA ATGCCAAGAGCTTTCTATTAGATACAAA CACCCGACTTTGGACACTCTGTTACTCAG GTTTTTTTAATCCCTCACATAGAAAAGCA CCAGAGTTGTCACCATACAGA | 0.001320494 | 0.008632826 | 6.05E-06 |
| 1438 | 2468096 | 1 | | TATTGGCTGCTGAGAGCCCTCCAGAATG TAGACGTCTGGTCTGGGGAAACTCAATG GATTTCTGTTCTTGGTACACGCACCCACT TATGTGTTCATGTCCCACCCCCCATCCTC ACAGCCATTACATGAAAGCATCTGAGTG TTGTACAAGGTTAAAGCTTTTTGTGTTAA TCTATCCCATATGGAGCAGGTATTA | 0.00199727 | 0.006948306 | 3.18E-06 |
| 1499 | 2468976 | 2 | IAH1 | TTTCCTCAGGCTTAAACCTTTGCCACTGA | 6.79E-05 | 0.009755437 | 5.56E-06 |
| 1773 | 2469870 | 9 | GREB1 | ACTTCGGGCTGTCGGAGTTTATTGAATCC ACCCTTTCAGGACACAGCCTCCCCTTGCT CAGATACGATAGCTCCTTTGAGGCCATG GTCACTGCATTAGGAAAA | 0.005601625 | 0.007192075 | 3.14E-06 |
| 369 | 2469885 | 4 | GREB1 | GTGCCTAGGCACTTTTTATATATCAGTCT CTCCCAACCTTTTATGCAATAGAAAATA TTTATCCTGGACACATAGAAATGGATAA GGCTCCTGACCCAGGGCTCTGGCTGCCT CAGGCCCTGGTGGGTCACCTGAAGCCAC GCCTGCAAGCCACCCAAGGTGTGCTGGA TGGGAGCTGTCCTATCTAGTGTCCTATTT A | 0.004872298 | 0.010268236 | 8.27E-06 |
| 660 | 2470495 | 2 | FAM84A | TCACTGATGGTGACACTACTTGTAATTAC TGTATTTTTTGGCAGAACACTCAGATGA ACAGATTCCTATGCTGTGGACTTTTATCA TTCTTTTTGATGGCTGATAGTAGAAAGC ACACAGTAGGTACTCCATAAATGTAAGA CTATGGCAGCTGTCTAGTACAAGTGCTT CTCACTGATTCTTGGTTACCAGGAAAAC CAGAAAGCCCGTCACTTGCCTTGCCTGC AAAGGCGAGCCTAAAG | 0.028813689 | 0.01106141 | 8.18E-06 |
| 1270 | 2470675 | 9 | DDX1 | AGCTTCTGATAATTGGAGGTGTTGCAGC CCGGGATCAGCTCTCTGTTTTGGAA | 0.000126422 | 0.011859396 | 8.45E-06 |
| 807 | 2471816 | 1 | | ATGGATCGGATTCTGGTGCAGAGAGGAA GGTTGAGAGAAATGGAGGAAGGTGAAA CCAACAAGAAGTGTCCGGACACGCTAGC AGGATTTCAGCATACAGAGCTAACAAGA TGCGGGG | 0.003031295 | 0.011034735 | 1.03E-05 |
| 1190 | 2472863 | 4 | KLHL29 | ACCTGAAAGAACCAAGTCGCCACGACTC CCAAGTGCCACCTCAGTAAGGGACCTCA ACGGGACGACCAAGGCCCAGTGGAAGC CTCGACGGCCCTTGACCATGGAAGCTGC CCAGAGCATCTCAAATAAGTCAGCAGCC TTTTCCACTGGGCCTATTC | 0.00028481 | 0.008335196 | 6.23E-06 |
| 1359 | 2472904 | 5 | ATAD2B | AATTACAGTGATGCGCCCCACCATATCC CAATTAAATACCTCTTTCATAACCAGCAT CCATCAACAGAATACAGTGCCCAATAAG AAAAGCAAAACCAGGATATCTTCTACCT TAATATA | 7.63E-05 | 0.010695906 | 5.99E-06 |
| 822 | 2473804 | 4 | EPT1 | ATGCTCAGGTGGAGTTTCATTTCTCTGAT CTATGTGCTTCTCCACTTTTGCTCAGCCA CACTGAATTTGCCTATTGTGTCCTGAATA TATTTT | 0.00515944 | 0.009520516 | 5.10E-06 |
| 604 | 2473817 | 2 | EPT1 | AGGAGCCTGTTATAATTCTGCAAGATCT GTGAATAGCATTATAAATCTGGGGCAGG TGCCTGTAATCCCAGCACTTTGGGAAGC CAAGGCAGGTGGATTGCTTGAGCCCAGG AGTTCGACACCAACCTGAGCAATGGC GAAACCCCGTCTGTAATAAAAATACAAA AAAATTAGCTGGGCATGGTGGCATGTGC CTGTAATCCCAGTTACTGGGAGGCTGA GGCAGGAGAATCACTTGAACCTGGGAGA TGGAGATTGCAGTGAGCAGAGATTGTGC | 0.000162598 | 0.009646651 | 3.60E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CACTGCACTCCAGCCAGAGTGACAGAGC AAGACTCCATCTCAAAAAATAATAATAA AAATAAACAAATCTGTTTAAATTACTGT TGCCTTTCAGCATTAGACTTTGAGTTTAA TAACTACAAATTGAGACTGCTCACAATA TTAACTTTTTTTGTAGGTTATTTTGTTGTT TAGATAACTTGCCTCCCTAGAGGAGCAT TCAGGAGATAAAGACCTAGCTACATGTA ATGATATGATCATTTCAAAAATGTGCCA AGAAAGCAAAATTCATTATTGAACTCTA AATTTCTGGGTGTTTTTTTTTTAAAGTA GCATTTTCTCTGGGTAAAGGGAAAGGCA ATGAATGATTGCCAACATGTAAACTCCC TGCTGCCCGCCTTCCCCAGTCCCCTCCA TCTAACATAATACAGTAAATTTGTAGCC AGTTGTAGAAAAGAAATTGATATCTTT CTGAGTAAGGTTTCATGCCCTGTGACTA AGAATAGGTGGAGGAATCATGGCCAAAT CAAATATGAATTGTTTAGCTTGGTCCTGT TGCAGTTGGCTTTCTGTAGTGTTCTGAAA CAAGAGGACGATTCCATTCCTTCTCAGG AACCTAGAAACAACACCGCTTGAGCAAC TGGAATATGTTTGCTGCAAGCAGAATAT TTTGGGGAGAGGAAGAGTAGTTTAATTC AAGTAGTTTAATTGAACATATTAGTCATT GGTCTGTCTGGGACGTGCAGTGTTCATA GTAGCAATGTATGTACCATTTATTTTATC TGGTTGTGTGATGTGTGTATGCCTA TTTAATATGTACACATATATTCACTACAT ATGTATGTATGATATATTCATATATACAT GCAGTCTGCTTGATTATCAGCAAAATGG TCAGCCTTTATCAGATAGTTTCTTCATGT GGAGTTCATCTGCATGTGGCCCTTACTCT GAAGC | | | |
| 740 | 2473976 | 2 | C2orf18; CENPA | GTGCATAACACACCTGGGTAACTTTTAT AGAGATGGGGTTTCACCATGTTGGCCAG GCTGGTCTCAAACTCCTGACCTCAGGTG ATCTGCCTGCCTCGGCCTCCCAAAGTGCT GGGATTACAGGCGTGAGACACCACACCC AGCCATAACTAAGCATTATGTTTTCTAA AACTTCTAAGATCCTCCCTAAACCCGTCT GGAGACATGGGTTTTAGCCCAGACTCTG CCTCAAACTCATTGTAGCTCCCAGCACA TTACCCAGTTGCTCTGGGCCTTGGTGTTA TGCTCTGGGAAGTAGATGTTGATGCTGT GGCCTTAGTGCCTTCTGGCCCCAGCATTC CATGGGCCTGTGATCTTGACCAACCTGA GAAAACAGTAACAGCCCATCCACTGAAA ATA | 0.000228432 | 0.008345388 | 4.46E-06 |
| 1033 | 2473979 | 2 | C2orf18; CENPA | CTGGGCGTTGCGTTAAGTTGCTTAACTTT CATTCTGTCTTACGATAGTCTTCAGAGGT GGGAACAGATGAAGAAACCATGCCCCA GAGAAGGTTAAGTGACTTCCTCTTTATG GAGCCAGTGTTCCAACCTAGGTTTGCCT GATACCAGACCTGTGGCCCCACCTCCCA TGCAGGTCTCTGTGGGTCTTTGGGATG GATCTCCTAGGGCTGGGCTGGAAGCCTC ATGTACTGTTGTCTTCTAGGTAACCACCC TGAAGAGAAGGGGTGGCATCAGGAACC GCAGGGAACCAAGCAGCCTTTGGTCCAG TGCTGCTCCTTGGAACAGTTGAGTGTGG CCTCAAACCATTCTCCTGGGTAGCTCAGT CATAAAACACCGAATGCCTGCCTCAAAA TAGCCTCTGAGGGAAGGGAGCTGTTGAC AAGTGAAGCCCTCAGGTTGTGTGGGATT CCAGCAGGTTATTACAGCTTGTGGGGGG AGGGAGGGTCCATTCCACCAGCTTT | 0.001106343 | 0.006681413 | 3.51E-06 |
| 1926 | 2474461 | 4 | TRIM54 | GGGCCATTTGTTCTTGACCGACTTCACTC CAAGGATCTGGTGTGGGCCAAGGCTAGG GAGTGGGCAGAAGGCGATGGCTGGTTGG | 2.15E-05 | 0.006718124 | 3.84E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1650 | 2475693 | 2 | LBH; AC104698.1 | AGAGAAGCCAGGCCGTCTAGTGGGGGA GGATGGTTGGAACATAGCATTGAAGTGG GCTCGGCTTTCAAGCTGCATACGGTGGC CCAGTG AGCAGTGGAGCCCTCTGACAATTTGCAA GGCCCTCTGAGAAAGGAAGCTGCTTAGA GCCAGGGGTTAGTGGGTGAGGGGAGC GAGTGCTGTTTTTGAGATCATTATCTGAA CTCAGGCAGCCTAGTAGAGGCAGTGGTG GGATTCCAATGGGTCTTGGTGGGTGGGA GGTGGGGCATGTGCAAAGCAAGCAAGG AACATTTGGGGTAAGAAAACAAACATGA GGCAAAAGAAAAATACATGTTTTTAAG AAAACATTGAGCAGAGAACTGCAGCCA GGATGCGCTCAGCAGACATTCACTCTGG CTGCTGGGACATCAGAAAACAAAGTCTT CATCTCTCTCTCCAGTTTCACCCACCCCA CCCTTTGCTTTCATTTCAGGTGTGTTGGT CTATATGACAGGGAGGAGAGTAAAGGA GAGCAGGAGCAATTGGCTGCCTGCAAAG CCAGCTGGAGGTGAAGTGCAGGAAAGG AAAGGTCACCCCATTCTACTCCATGGCC TCTCTGCTCCCAGCTGTGGTAGGCTCACA TAGCCAGTGTGATCGGTTTTTAAGAGGC AGTGCTTTTCAGCTTTTCTCCCTGATATA TCCATTTTGCTTCCCAGCACTTTTTAGGA GTAGTGAGAGCACTTCCTGCCCTTGTTG GAAGCCCCAGGGTGGACACTCAGCACGA AGGTCTCTCCCTTAACTGCTGCCCTTCCA AGACTTGCTCCCGAGATGGAGTGGGCGT GGTCTTCCAGGCTGGCCCTTCCTTCTCCT CACCGCCACCTTCCCTGCCCCAGCCCCA GCAGCCATGGGTACATGGGTCCCCAGCT CACCTATGGATTCCCGCCAGTCTGCCCA GCTGCAGTACTCACGCCCCATGGGGGAT CTTGGTCTGTTTTTCTTGTGGGAGCCTAG TGGAGAGCAGACGTGGCTTTTTATGTGT CTTGTTGGGGAGGTGACTTGCATGGTGG GGACAAGGCTGTCGTGGCAACCTTGGGA TCGAGTTTGAGACTAAAGGATGTCATGA GATCCCTGGCTTCTCCCCATGTTGTTCCC GGACAAGGGCAGAAGGGAGGCATGGCA AGGGACCTCTGCTGTCCTTACTCAACAG TGGTCCTCATCCCTCCCCACCTCCCACTG CTTCCTGCAAGGGCACCAGTTGTATGAG AAAGTTGGCCTTTGGACTTAGGATTTCTT ATTGTAGCTAAGAGCCATCTGAAGCAGC AGGTTGCAGGACAAATGCTTCAGTCCGC CGAGAGCAGTACCGTGTGGCCAAGAGGT GGACTCAGAGCCTTCCTTGAGCTAAACT CGGCCAACCAAGGCACGCAGCATGTCCC CTCAGGTCTCCAGTCAGTCCAGGTTG | 2.46E-05 | 0.010241028 | 5.98E-06 |
| 291 | 2475695 | 2 | LBH; AC104698.1 | CCCTAGACCACTTTGTATGACCGTTTGCA GTCTGAGCAGGCCAGGGGCTGACAGCTA ATGTCAGGACCCTCAGCGGTGGAGCCTG CTGGGGGACCCAGCTGCTCTTGGACAA GTGGCTGAGCTCCTATCTGGCCTCCTCTT TTTTTTTTTTTCAAGTAATTTGTGTGTATT TCTAACTGATTGTATTGAAAAAATTCCTA GTATTTCAGTAAAAATGCCTGTTGTGAG ATGAACCTCCTGTAACTTCT | 9.56E-07 | 0.016675474 | 1.27E-05 |
| 1191 | 2477478 | 1 | | TCTCATGGCTGAAATCCGATGAGGCATT GGACCTCCTCACGCAGAGTCTTTGGATG CTTCTGTCTGAGCCTGAGCAGTGGGCCA GATGGACTATCGGTCTGCCTCA | 0.000269075 | 0.00759234 | 2.13E-06 |
| 857 | 2480873 | 5 | CALM2; C2orf61 | CAGTCAGTCCAGAGCACATGAGATCAGC T | 2.34E-05 | 0.007532819 | 2.91E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1481 | 2483422 | 1 | | AGGAGTGTCAGGCTCGACGATCACCTCA ATGCAGGGCAGATCCTGGGGATGCACTC TCCAGCGACACCGCACAGAGCTTCTTCC CG | 0.000297559 | 0.008805039 | 2.45E-06 |
| 641 | 2484202 | 5 | BCL11A | CTCAGAAGACAACCTGGATGTGACCGAC AACTTCTTTGTGATGGATCTGAACAGCCT CCCTTGGTTCTAGCAGAAGGACTTACC | 0.015223504 | 0.008222288 | 7.55E-06 |
| 732 | 2485722 | 2 | CEP68 | GCTGAGCTCTTAGCCACTACCCTTGGCTG CTTCCTAACTCAGAGGTATTCTGAACAA AAAAGGTTTTGTGCACAGATGCCTTTAG GAAACACTGGGCTAAACAAAGGTAAGT GGCTTTCTTGACTGCAGGACTTCTAGAG CTTCATTTGCCACAGTGGTTTAAGTGCAA AGTTAGGGGCATTGGATGTACTGTTGCC TAGACTTTGTGGCCACCGGACCATCTTGT GAACCAAATGA | 0.000146537 | 0.008285681 | 2.36E-06 |
| 1594 | 2487212 | 2 | ANTXR1 | CTGGGCTCTCTCAGAAACTTCAGGAGAT GTTAGAACAAGTCTTTCCAGTTAGAGAA GAGGAGTGGTGATAAAGCCCACTGACCT TCACACATTCTAAAAATTGGTTGGCAAT GCCAGTATACCAACAATCATGATCAGCT GAAAGAAACAGATATTTTAAATTGCCAG AAAACAAATGATGAGGCAACTACAGTCA GATTTATAGCCAGCCATCTATCACCTCTA GAAGGTTCCAGAGACAGTGAAACTGCAA GATGCTCTCAACAGGATTATGTCTCATG GAGACCAGTAAGAAAATCATTTATCTGA AGGTGAAATGCAGAGTTGGATAAGAAAT ACATTGCTGGGTTTCTAAAATGCTGCCTT CCTGCCTCTACTCCACCTCCATCCCTGGA CTTTGGACCCTTGGCCTAGGAGCCTAAG GACCTTCACCCCTGTGCACCACCCAAGA AAGAGGAAAACTTTGCCTACAACTTTGG AAATGCTGGGTCCCTGGTGTGGTAAGA AACTCAACATCAGACGGGTATGCAGAAG GATGTTCTTCTGGGATTTGCAGGTACATA AAAAATGTATGGCATCTTTTCCTTGCAA ATTCTTCCAGTTTCCAAGTGAGAAGGGG AGCAGGTGTTTACTGATGGAAAAGGTAT GTTGCTATGTTGATGTGTAAGTGAAATC AGTTGTGTGCAATAGACAGGGGCGTATT CATGGGAGCATCAGCCAGTTTCTAAAAC CCACAGGCCATCAGCAGCTAGAGGTGGC TGGCTTTGGCCAGACATGGACCCTAAAT CAACAGACAATGGCATTGTCGAAGAGCA ACCTGTTAATGAATCATGTTAAAAATCA AGGTTTGGCTTCAGTTTAAATCACTTGAG GTATGAAGTTTATCCTGTTTTCCAGAGAT AAACATAAGTTGATCTTCCCAAAATACC ATCATTAGGACCTATCACACAATATCAC TAGTTTTTTTTGTTTGTTTGTTTTTGTTT TTTTTCTTGGTAAAGCCATGCACCACAG ACTTCTGGGCAGAGCTGAGAGACAATGG TCCTGACATAATAAGGATCTTTGATTAA CCCCCATAAGGCATGTGTGTATACAA ATATACTTCTCTTTGGCTTTTCGACATAG AACCTCAGCTGTTAACCAAGGGGAAATA CATCAGATCTGCAACACAGAAATGCTCT GCCTGAAATTTCCACCATGCCTAGGACT CACCCCATTTATCCAGGTCTTTCTGGATC TGTTTAATCAATAAGCCCTATAATCACTT GCTAAACACTGGGCTTCATCACCCAGGG ATAAAAACAGAGATCATTGTCTTGGACC TCCTGCATCAGCCTATTCAAAATTATCTC TCTCTCTAGCTTTCCACAAATCTAAAAT TCCTGTCCCAAGCCACCCAAATTCTCAG ATCTTTTCTGGAACAAGGCAGAATATAA AATAAATATACATTTAGTGGCTTGGGCT ATGGTCTCCAAAGATCCTTCAAAAATAC ATCAAGCCAGCTTCATTCACTCACTTTAC | 0.006898401 | 0.008932501 | 1.10E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
|  |  |  |  | TTAGAACAGAGATATAAGGGCCTGGGAT GCATTTATTTTATCAATACCAATTTTTGT GGCCATGGCAGACATTGCTAATCAATCA CAGCACTATTTCCTATTAAGCCCACTGAT TTCTTCACAATCCTTCTCAAATTACAATT CCAAAGAGCCGCCACTCAACAGTCAGAT GAACCCAACAGTCAGATGAGAGAAATG AACCCTACTTGCTATCTCTATCTTAGAAA GCAAAACAAACAGGAGTTTCCAGGGA GAATGGGAAAGCCAGGGGGCATAAAAG GTACAGTCAGGGGAAAATAGATCTAGGC AGAGTGCCTTAGTCAGGGACCACGGGCG CTGAATCTGCAGTGCCAACACCAAACTG ACACATCTCCAGGTGTACCTCCAACCCT AGCCTTCTCCCACAGCTGCCTACAACAG AGTCTCCCAGCCTTCTCAGAGAGCTAAA ACCAGAAATTTCCAGACTCATGAAAGCA ACCCCCCAGCCTCTCCCCAACCCTGCCG CATTGTCTAATTTTTAGAACACTAGGCTT CTTCTTTCATGTAGTTCCTCATAAGCAGG GGCCAGAATA |  |  |  |
| 1005 | 2487217 | 2 | ANTXR1 | ATGACGAGACCCTTGTTTGCACAGCATT AATAAGAACCTTGATAAGAACCATATTC TGTTGACAGCCAGCTCACAGTTTCTTGCC TGAAGCTTGGTGCACCCTCCAGTGAGAC ACAAGATCTCTCTTTTACCAAAGTTGAG AACAGAGCTGGTGGATTAATTAATAGTC TTCGATATCTGGCCATGGGTAACCTCATT GTAACTATCATC | 0.000374519 | 0.013610335 | 2.20E-05 |
| 1684 | 2487383 | 4 | AC092431.1 | GCAACAGTATGTTCAATCCCATGTGCTCT TCCAAAAACCCTACCCCCTACCTCAATC AAGAGATGGCATCTATGTCCTTTCCCCTT GAACCCAGGTAGGCTTCTCGGACGGGTT TCTGTGACTGCACCTCTAAAGTAATGCT ATGTTGG | 0.000701725 | 0.007954263 | 5.49E-06 |
| 432 | 2488699 | 4 | SMYD5 | TTGCCCAAGACGTAAGACCTCTAGTTGT CTGTTGTCTGCTCTCAGCGTCATCATATT GATCTAGTTTTCCAGCTCA | 7.87E-05 | 0.015768425 | 1.14E-05 |
| 1395 | 2489016 | 4 | ACTG2 | CCTGGCTGATTTCTTGGTCTCTTGCCCTC ATTCACCGAATTAATTCTCTACACTGCTG CAAAACTGATCTTTCTAAACACAGGTCA GCTCATGTCACTCACCTCCTCAGAAATCT TCAGTAGCTCTTCATTAACCAACAGGGG GTTCCTAACTCCCCGTCTTGGCATTGGAG GACCTTTCCCTGCCTGATCCCCGCGATCA TCTTTTCCTGCAATATTTACTCAGGCCAG TGCTCACCCCTTCTTTAAAATGCTGGTGC TGGCTCAAGAGAGGCAAACAGCCATCTC TCTCATTCTTATCTTCCCTGTCAAGACTT CACATAGGTGGACTGATGCTAGACTATG ATGATGAGTCTCCAGTGAAAGTTTCTAA GTAGAACTCTCTCAGGGTTTCTAGAAGC ATTTTTGTTTAAGAAAATATTGTGGGGG GAGCGGGATTTTTAAATGGTGGAGCTCA TGGTAAACAAAATTATGTGTGCAAAATG TTAATAGAGCCTTTCTAATATTCTTGTGA TTAACTCTGGTGACAGTTGGCTGAGTGTT CTTGTTTCTGCAACGCCTGTCTTTG | 0.022775596 | 0.007854953 | 6.38E-06 |
| 982 | 2489925 | 1 |  | ATCTGTGTGACCCTGTTCAGACATGCAT GCCT | 0.004689092 | 0.006770824 | 1.87E-06 |
| 169 | 2491288 | 2 | TMSB10 | TGGGAGCACCAGGATCTCGGGCTCGGAA C | 1.18E-07 | 0.02981693 | 4.03E-05 |
| 1034 | 2492588 | 6 |  | GTCAGGGGAGGGACTTATATGATTTGGA TCTGTGTCCCCACTCAAATCTCACACCAA ATTATAATCCCCAATGCTGGAGGTGGGG CCTGGTGGGAGGTGATTGGATCATGGGG GCAGTTTCTTATGCTTTAACAACATCCCC CTTGGTGTTGTCACAGTGACAGTAAGTT ATCACAAGATCTGGTTGTTTAAAAGTGT GTAGCATGTCCCTCTGTC | 1.82E-05 | 0.009689749 | 6.82E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1538 | 2492639 | 6 | | AGGGAAGCCAGGTTGTTCATGGACATTC AGTGGAAGAATTAAGGCAATTAAATGTT AAGTTTTGCAGGGCTGGTCGACAAGAGA A | 0.00115456 | 0.007687908 | 5.59E-06 |
| 1697 | 2496842 | 9 | MAP4K4 | GACCGCACTGGCCAAAGAGCTTCGAGCA GTGGAAGATGTACGGCCACCTCACAAAG TAACGGACTACTCCTCATCCAGTGAGGA GTCGGGACGACGGATGAGGAGGACGA CGATGTGGAGCAGGAAGGGGCTGACGA GTCCACCTCAGGA | 0.000896506 | 0.006816041 | 2.44E-06 |
| 719 | 2500274 | 4 | BCL2L11 | CCACGGCCTCTGTCTCTTAGGGCGACTG GGCGCGGAAGAAAAGCTGGAGAGCCCC TGCGGGGTGGCAGGAGGAGGGTGCCTG AGTCCCGCGAGAGGCCCGGGCGAGGAA GATGCGCAGCCTGCTGATCCGCGTCCCG CCCGGCGCCAGGGACCCTCAGAGGGAG GAGAGCTCAAAGACCTCGCCCCGCGCCT TCGCGAGGACCAACCCAGTCCCCGCGCC TGCCCCAGAGCGGCTTAGAAACTCAGGG CACAGTGAGAGCGCAGGGCGCCTCCC | 0.000106893 | 0.013001365 | 7.72E-06 |
| 129 | 2500383 | 6 | | GGAAACCGACCAGACCAGCCCATGACCA AAATATCACAGGCAGACCACCCGCAAAT GCAGAGGCCTCAGAGTCCACAGTGGGCA GTTGGAACCAGGCCCCAGGGAATCTTTC AGCTGCATTCCGGCTGTGATCGGCGGGC AACAGGTAGAGGTGCTGGAGGGGGATG AGTCGTGATTTTCAGTGTCTGTCATATTC GATCAAGTGTG | 0.000862602 | 0.031191838 | 3.41E-05 |
| 1098 | 2500950 | 4 | SLC20A1 | TCTGCCCTTTTCATCGATGTGAAGGCTGG GTTAGCAAGTTGAAGTTTATCGTTTCGA AGCTGAGGGATGCATAGACTGCAGTGGT GTTAGGAAGAACGCTGCGTCACCGCAGC TGAACCGAAGAGCCTCCGAGAGGTTCTG TGCTAGTCTGGCTGTGCCGAGTGCACGG TGGGAACCAGGCTTTCAGGACTCTCTGG CCTCATTTTCCCTCTCTGGGAGGAGTTGA GACAAGTCTTGCTTTATGTTAGTCAGTCT GTAGTTTGACTGAGGTGCCTGGATGGAT AGGTCAGCATACTG | 0.016212799 | 0.007999574 | 6.76E-06 |
| 1080 | 2502419 | 1 | | AGGCTGAGAATGTGGATCGTCCTCCGAA GACGCTGTCCAGGGAAGACCTGGAGTGA ATCATGGGCCAAGGGTGGAGGCCAAGTT ACGGGGACAGAGAGGCGAAGACAAGGG CAGCAGTGCCCACAACAGGAATTCCTAC CCTTCAACTTTGTTCATAGTGGTCCCTAC TTTTA | 0.009101689 | 0.00713435 | 5.92E-06 |
| 942 | 2503248 | 1 | | CTGGAACTTTGAGCCCCAAACCTGGTGA CCCCACGAGCACCTCGCACTTCTTCACTT TTCCTCGGTTTTACATCACAT | 0.032905271 | 0.009185376 | 8.32E-06 |
| 1587 | 2504114 | 4 | CNTNAP5 | CTGCGCAGTCCAGCCTTTCTCCTGTTGGG TGATGCTGCTAAGCATGCTCCCAGGATA GAGGAAGCATCTGCCATGCTTGTGGGTA GACATGGGTTACTAAGTAACA | 0.020351547 | 0.006559961 | 4.15E-06 |
| 1404 | 2504466 | 1 | | TGGAGACCACCACTGTCCACGTGCGCAA AGCGACGTCCCAGTTTCCTCACGCGTGG GCTGCAGCTT | 0.001732949 | 0.007924953 | 6.78E-06 |
| 1730 | 2505547 | 3 | PTPN18 | TATAGGTTATAAGTATAGCTGCCTGTGCT TCCACCACGAGCACCTGGGGTGTCTTGT GGCATGATTGAGCTAGCTCTGAAGCTGA CTCCCTCTTC | 0.033429032 | 0.007152644 | 5.39E-06 |
| 736 | 2508938 | 5 | ZEB2; ZEB2; AC009951.1 | GCCATTTTCATAGCGGGAGTGGACAGGT TTTCAAAAAATTCAAAGTAAGTGCTATA GTTATTTTCTTTTCTTTTCTTTTTTTTTT TATCACACTCCTAAAACCAAGTAGAAGG GGAATGCTGGCTTTGTACTGGATAATG TGAGTCCCCATGTAAATTGTGAGCGATT GCAAAGTACGGAAAGGTTTATTACCTAA GGTGAGCCCTCCCAGAGCTCCCGGAGTA TAAAAGCATTAAGCGCATGTTCTAACAA AC | 0.000595218 | 0.008601963 | 6.26E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 302 | 2510012 | 4 | LYPD6B | TGCTCAGATGCATAAGGAATACCAGTAA AGAACATATCACCTACTTTTTCTTTGCTT TTGAGAGACTGCTCTATTTTTTATCTTGC CTAGTGTTCTGATCCCCTTGGTTGTAACC ATAAGAAAATCTGATGAGAATTATGTAG GCCATCTGCCCTAACTTCACAAATGAGA GAAAAGGAGACTTTACCTGGGGAACCTC ATCTCTTTTCTGATGAAAATGATGAGT AACCCGTGATTGCTTGAAATACAATGTT GAATGGGTGAATAACAAAGGGCATGTG AGATTTGTGGGGTTGCTTGCATGCTTCCT AAAACTCAGCATATATGGCACATCCTTT AAACAGAAAAGGTCCTCTGCTGGTTAT C | 0.001713115 | 0.010465528 | 8.12E-06 |
| 1633 | 2511767 | 4 | UPP2 | GGTAGCTGATTTCCGCCTGCAAATAGCT CTCCCCCAGGCCACTGCTGCAGCCTTTCA TGGAGTAGACCCCTTCTA | 0.000134132 | 0.009381362 | 4.93E-06 |
| 1883 | 2512731 | 9 | PSMD14 | ATTGATGCCTTCAGATTGATCAATGCTA ATATGATGGTCTTAGGACATGAACCAAG ACAAACAACTTCGAATCTGGGTCACTTA AACAAGC | 2.46E-05 | 0.008283694 | 5.51E-06 |
| 1140 | 2514422 | 9 | BBS5; RP11-724O16.1; KBTBD10 | CTGGCTGGATCTCTGTATGCAATTGGTG GTTTTGCTATGATTCAACTGGAGTCTAAA GAATTTGCACCCACTGAAGTCAATGACA TA | 0.000293755 | 0.012231572 | 7.96E-06 |
| 241 | 2514660 | 9 | UBR3 | GAAATCCCTGGCCTCCATATAAGAAAAG GACATCACTCCATCCTAGCTATAAAGGT CTTATGAGACTTTTGCACTGTAAAACTTT ACACATTGTGCTATTCACTCTGC | 0.043299568 | 0.009434778 | 9.95E-06 |
| 303 | 2515814 | 2 | RAPGEF4 | TGTGTCTTCAAGCTTTTCCATGGAGTGGC AAAATGATTCAAATCCAGAAAGGAAGG GAGTGAAGTTATTAGGAGCTAACTA | 5.13E-05 | 0.012849118 | 1.19E-05 |
| 849 | 2516546 | 8 | ATF2 | AAACATCTGTTATCATGGGCTGGGCACA GTGGCTCATGCCTGTAATCCCAGCACTTT GGGAGGCCAAGGTGGGTGGATCACGAG ATCAGGAGTTTAAGACCAGCCTGGCCAA GATGGTGAAACCCTTTCTCTACTAAAAA TACAAAAATTAGCTGAGCGTAGTGGCAG GTGCCTGTAATCCCAGCTACTCAGAAGG CTAACGCAGAGAACTGCTTGAACCCGGG AGGCAGAGGTTGCAGTGAGCCGAGATCG CGCTACTGCACTCCAGGCTGGGTGACAG AGTGAGACTCTGTCTCAAAAAAAAAAA ACACCAATATCTGTCATCATGTAGGCAC AGCCAAGGTGAACTGAAGCAGGATACG AACACTCAGTACATTCATGACTATCTTCA TACATTCCTGAAATGATCCTAGAGATCA CCTTGGGAATAGCAAAGTGGTCATA | 0.049782645 | 0.008503428 | 5.55E-06 |
| 170 | 2518113 | 8 | AC009478.1 | AATAAATCTGTGAGGTCTCCCATCAACC TGAAAG | 3.25E-07 | 0.026250826 | 2.61E-05 |
| 1251 | 2518123 | 1 | | TGCACCTGTTTAGTTTGTGACAATCTGAG CCCAGTACATGGTTCTCTGATTCCTAAGC CAGGAGTCTCTCTGTAACCAAACTGCTA TTATGTGAGCATAGAACAGCTCTCAAAG TAAATGTCCCACTTCTATTTCTGGCAGGT TATGTTTAGCTACCTTTCCAAAAGAGTCC CAATCCTAGTATGCCTTTCAACAGTGTC | 6.28E-06 | 0.013391344 | 1.23E-05 |
| 317 | 2518126 | 1 | | CTTAGTGGGGTTTGGAACTGCCTGAGAA TATTCCTATAGAAACTGGGTCATCTTGCC TTCTGTGCCACTAGAACCTCCTGTCTCTC CAATAGCTGCTTCTCTCTAATTCTTCACC ATAGTTTTCTTTCTGTGGTCTTTTGAGGT TCTCTCCT | 2.05E-05 | 0.020141631 | 1.48E-05 |
| 1537 | 2518128 | 1 | | CATAGCTAGGCAGTGTTGGAGATCAGCA GGAACTAGACACAATGAATGGATATGGC ATCAATACTCATGAACATGGCATTCTTCC AGCAGTGCTTGGCAACTCAGGTTGAGGA ACAGAGAAGGTGGATGGCTTAGGTAATG GAATTGGATGCTTTTTAAATGTCAGTGG CTGTCAAAACTGTATA | 0.000144203 | 0.008894878 | 3.10E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1719 | 2518146 | 1 | | TGGCATGACATAGCTAAAGCACTGAAGG AAAAAGTATTTTATCCTAGAATAGTATA TCCAGTGAAAATATCCTTTAAAAATGTG GGAGAAATAAAGACTTCTCCAGACAAAC TAAAATAAGGGATTTCATCAATACCAGA TCTGTCCTATAAGAAATGCTGAAAGAAG TTCTTCAGTCTGAAATAAAAGGATGTTA ATGAATTAGAAATCATTTGAAGGTGAAA AACTCACTAATAATAGGAAGTACACAGA AAGAGAACAAAAAAACACTGCAATTTTG GTGTGTTAACTACTCATATCTTGAGTAGA AAGATAAAAAGATGAACCAATCAGAA ATAACCACAACTTCTTAAGACATAGACA GTACAATAAAATTTAAATGCAAACAACA AAAAGTTTAAAAGCTGGGGGATGAAGTC AAAGTGTACAGTTTTTATTAGTTTTCTTT CTGAGTGTTTGTTTATGCAGTTAGTGATA AGTTATCATC | 3.51E-05 | 0.00934739 | 5.22E-06 |
| 1852 | 2518152 | 1 | | TAATTCAGTATGCTGTCCAGGGGCCTGG AAATCACTCAGCACAGTCTACCACCATT GGCACATGAACACTTCTCCCAGGGTCTA AGGACAGGCTGACATAACATGCTAATAC CACCAGAGCTGGCACTCACCCAGATGTA CCACATCAGGCCAGGAAGCAGAAACTAC CAACATCCCAGCAAACCATGTGGAGGCC CCCAAATCAGACTGCTTGGGCCTAACA | 0.009120022 | 0.007551326 | 5.14E-06 |
| 1965 | 2518159 | 1 | | AATGGTTGTTCAAGCCAGGCCTGCCTCA TTGAAAGGGTGAAATCTTCCTTCACTGG AAGGAAGTGAGAGAATTAGTCAAGCAG CTATCTGAGGAAAGAACATTCCAAGTAA AGAATATACAGCCCATACATTGTTGGAT GTGTGTACATTGAAATTTTTGTGCAGTAA AATGAATATTTCATTTACCTATATAATTT TACATAAAATAAAATATATTTTGAATGT GAGTTTGTTCCAAACAAATCATTTTCTTG CCTTCAAAACCACTGAGCTTAAAGAACT CTTTCAAGTGTCATTAGAGATAGATTCC AACTACAATCAACATTGTGGAATCCAGA GGAGGCAAAATGAAGGAAGCAGCACTC ATTACAAAATGCTGCTTTGTAAAGAATT AATTCTGTCCTGGTATGTTTCACATTAGG TAATATGAAGGAAATGAATATGTCATGA ACCCTCCTTGAGGATGTGGGGAATTAA AAGTAATTTCGCTTAATATCCAACTCTCA CTTTTGGCTTTGTAGTCAGAGGGAAACA ATGCTTTCCCAGGTTCTAAGGTAAACGTT AAAAGGTTACAAGGAGACTTGGAAGAG TCAAGGAACGCTTCCACCAACTATTCCT GCCATTCCAGTTGGGAGGGTT | 9.59E-05 | 0.006815639 | 4.29E-06 |
| 357 | 2518161 | 1 | | TGTCCAACAGGTGACACACATGTTAAGT GGCAGAAATGGAGTTTGAACCATGTGTT ATGGCTCTAGGGCTCAAGCTCTTAACAC TATCCCAAGTAGGGTGGGAAAGGACAAT TTGCCTCACTC | 2.94E-05 | 0.018291423 | 1.92E-05 |
| 1470 | 2519298 | 4 | FAM171B | GCCCAGCCTTTGGTCCCTTGATCTGGTGT CGGGAATCTGCCCTCCGGGTAATGAGCT TTCTGA | 0.000281159 | 0.008194504 | 4.50E-06 |
| 2016 | 2519657 | 2 | COL3A1 | CTCTTGTTCTAATCTTGTCAACCAGTGCA AGTGACCGACAAAATTCCAGTTATTTAT TTCCAAAATGTTTGGAAACAGTATAATT TGACAAAGAAAAATGATACTTCTCTTTTT TTGCTGTTCCACCAAATACAATTCAAAT GCTTTTTGTTTATTTTTTTACCAATTCCA ATTTCAAAATGTCTCAATGGTGCTATAAT AAA | 4.06E-05 | 0.008943244 | 6.69E-06 |
| 2051 | 2519667 | 5 | COL5A2 | TGTCGATGTGTCTTGGCTTACTTTACACA AAACAAACTGGCCCAATTTCAACGCCGA ATTCCTGGTCTGTGCCGCCAACATCCAC AGGAGCAAGATCTATGATGGGCAAGCGT GCCACATTCTGTGTTC | 0.000620704 | 0.007056377 | 5.54E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1620 | 2521265 | 2 | CCDC150 | TCTGCCTCAGAGACTCCCTGATTGGCCCC TTTTCTGAGAGGATGTGCTATCTCTGCAG T | 0.01434388 | 0.007186124 | 3.87E-06 |
| 1321 | 2522030 | 4 | C2orf47 | GTACTGCCATATTCCACATGCCCGTTCCC TCACGTGGTGTGTAGGTCCTGGGGATGT TAAACACTTATGGA | 0.000509079 | 0.007679796 | 4.01E-06 |
| 84 | 2522842 | 7 | ALS2CR4 | TGTCCAGCAGCTCACTCTGTTCTTAGGGT TCATGTTATGCAACATAAAGTACACAGC ATCACAGATGAAGTCATATTTTTTTAAA AAATCTAATCAAACCACCAGACCTAACC TCCAGTCTATAGGAAATTCAGGAGATTG AGGAACAAATTAAGTGATGTCATTAGGA AAAAGTCAGACAATTAAAAAATGTAGGT GAGGCACTCTAAAGCAACTAGCTTGGAC TCTTCAAAAAATTGTCATGGGAAATTAG AATGGTACCGCCAACTCTGGAAAACA | 0.003428273 | 0.021356529 | 1.53E-05 |
| 492 | 2523250 | 9 | BMPR2 | GGCCAAGCATGTTTGATTCCTGATGTTCT GCCTACTCAGATCTATCCTCTCCCCAAGC AGCAGAACCTTCCCAAGAGACCTACTAG TTTGCCTTTGAACACCAAAAATTCAACA AAAGAGCCCCGGCTAAAATTTGGCAGCA AGCACAAATCAAACTTGAAACAAGTCGA AACTGGAGTTGCCAAGATGAATACAATC AATGCAGCAGAACCTCATGTGGTGACAG TCACCATGAATGGTGTGGCAGGTAGAAA CCACAGTGTTAACTCCCATGCTGCCACA ACCCAATATGCCAATGGGACAGTACTAT CTGGCCAAACAACCAACATAGTGACACA TAGGGCCCAAGAAATGTTGCAGAATCAG TTTATTGGTGAGGACACCCGGCTGAATA TTAATTCCAGTCCTGATGAGCATGAGCC TTTTACTGAGACGAGAGCAACAAGCTGGC CATGATGAAGGTGTTCTGGATCGTCTTGT GGACAGGAGGGAACGGCCACTAGAAGG TGGCCGAACTAATTCCAATAACAACAAC AGCAATCCATGTTCAGAACAAGATGTTC TTGCACAGGGTGTTCCA | 3.28E-05 | 0.012246342 | 1.00E-05 |
| 1635 | 2524751 | 4 | FASTKD2 | GACAGATATTTGCATCGGGATGACATCT GTG | 0.000873066 | 0.00892817 | 5.63E-06 |
| 915 | 2527797 | 3 | CTDSP1 | CGCACTCCCTATGTGGGCGCCTTAATAC CTGCTAGACCTATTTGTCTGGGAGCTGC AGGAGCCTTGCAGTTGATTGTGGAGCCC TGACAGGGGCGTTTCAGAGAAAGTCAGG AGCTGCCTTCGTGTGTCTGGATGAAGGG GCCACGGCAAGATCCTCCTGGCTCAGGG GTTCACACCTGGGCACACATGCAGGATT CTGCAGGCCAGTGTGCACCGAGCCTCCA ACTTGT | 0.00051035 | 0.00707731 | 4.80E-06 |
| 198 | 2528111 | 9 | CYP27A1 | AGCTGATTGATGAGAAGCTCGAAGATAT GGAGGCCCAACTGCAGGCAGCAGGGCC AGATGGCATCCAGGTGTCTGGCTAC | 0.006771364 | 0.012183336 | 1.06E-05 |
| 1455 | 2529187 | 5 | EPHA4 | ACCACCCTCGCTGGACTCATCATCAAAG TAAAAAGTCAGCTCCACCCCCAACAGCT TTTAGTTGCTACATCATGCATCCACAC | 0.001895132 | 0.006902755 | 5.45E-06 |
| 850 | 2533263 | 3 | TRPM8 | GTTGATATTTCCAAGCTGCTGATGTCCC | 0.006310467 | 0.008441188 | 3.54E-06 |
| 1064 | 2533688 | 4 | AGAP1 | TTGTCTGTGCACCACTGCGGAACTGTGA GCTCCCAGAGTGCACAGATATGTGCGCA ACACCAAGATCAGAATGGGTGCTTCGCA GTGCTCAATACATTATTTATTGAATGACT TAATGTAGAATGACTAGTTACACAGTTC AGGTGCTAGGAGGCAGTATAAAAGTCAG AGAGCAAATGCTTTAAGAAACTGTAGTA TACACCAGGAAATGCAATTCTTTAGTTA GATACCTTCTCCTTTCAGTAAAATTATGT TCAGTGCTGTAAATAGGCAACTTTCAGT GATTTGTTTTCAAACAAGTGGCTTTTTA TCTTTTCCTCTTGACAGTGAGTGTCTCTC CATGTGTGAAGTATTTTCTCCTCTCATAT CTGAAGTCCTGCTTGTAAGTGTTTTCGG TTATGCAACATTTCATGGGGAATTTGAG | 0.005613406 | 0.008401337 | 5.08E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 682 | 2534019 | 2 | CXCR7 | CACTGGAATTCTTGGTCGCTAGTTAGGT GGGTCTTACCGCA AGCAAAGTAGCTTCGGGTCTTGATGCTT GAGTAGAGTGAAGAGGGGAGCACGTGC CCCCTGCATCCATTCTCTCTTTCTCTTGA TGACGCAGCTGTCATTTGGCTGTGCGTG CTGACAGTTTTGCAACAGGCAGAGCTGT GTCGCACAGCAGTGCTGTGCGTCAGAGC CAGCTGAGGACAGGCTTGCCTGGACTTC TGTAAGATAGGATTTTCTGTGTTTCCTGA ATTTTTTATATGGTGATTTGTATTTAAAT TTTAAGACTTTATTTTCTCACTATTGGTG TACCTTATAAATGTATTTGAAAGTTAAAT ATATTTTAAATATTGTTTGGGAGGCATA GTGCTGACATATATTCAGAGTGTTGTAG TTTTAAGGTTAGCGTGACTTCAGTTTTGA CTAAGGA | 0.007173756 | 0.01141102 | 7.05E-06 |
| 1657 | 2534732 | 9 | FAM132B | GCGCGGAGCCCGAACCCTGTACGTGTGG CCCCGCCGGGCCGGTCGCTGCGAGCCTC GCCCCGGTCTCGGCCACCG | 1.12E-05 | 0.009726611 | 8.21E-06 |
| 728 | 2535587 | 1 |  | CCAGCGGTTCCTCCAGTGACGCTGAACT TGACCAGAT | 6.50E-05 | 0.008364795 | 5.93E-06 |
| 862 | 2535780 | 4 | GPC1 | TCCGGCTGCGCGGTTTGCCGTCTTCGTCC CTGGCCGCGGCGGCTGGCGACTGGCATC GGGGCGCCCGGGACCCCCAGGGCGGCG ACGCTGCCGCCGGTGCCGCCGAGCCTTT GTTCCGCCGCCGGGGCCGGTTTCACGCC TGTCGCCCTCGCAAGCAGCC | 0.04726916 | 0.007338948 | 3.68E-06 |
| 354 | 2536222 | 9 | ANO7 | CTGAAGCTAGACAGGCAGCAGGACAGT GCCGCCCGGGACAGAACAGACATGCAC AGGACCTGGCGGGAGACTTTTCTGGATA ATCTTCGTGCGGCTGG | 2.05E-05 | 0.014644119 | 1.34E-05 |
| 71 | 2536223 | 9 | ANO7 | TGACCCATGACCTTGCCGCATGAGGCCT GAGGGCATGGTGTCCAGAGTCCCAGAGC AGATCAGGCCCCAAAGTCCTGCTGGACC CCCCAGCCACCGTGAGCTCCTCCGTGTG GCTAGGGAGCTGCTGTCCAGAGGCGGAG GTAAACATTGATCCCTCCTGCACACTCA GCTCTCTCATGGAAGTCGGAGCCCTCAG GGTCACCTGAAAACTCT | 0.000206799 | 0.028782637 | 2.44E-05 |
| 485 | 2536224 | 2 | ANO7 | TTGCCATTCACCTGTCCCGTCTCCAACAT TAAAGCTT | 0.000570716 | 0.011820556 | 1.20E-05 |
| 277 | 2536236 | 9 | ANO7 | CGAACCCCATCACGGGTGAGGACGAGCC CTACTTCCCTGAGAGGAGCCGCGCGCAG CGCATGCTGGCCGGCTCTGTGGTGATCG TGGT | 2.42E-05 | 0.016689851 | 1.24E-05 |
| 140 | 2536237 | 9 | ANO7 | TGTGCCTCGTGTCTATCATCCTGTACCGT GCCATCATGGCCATCGTGGTGTCCAGGT CGGGCAACACCCTTCTCGCAG | 0.017291959 | 0.017903985 | 1.67E-05 |
| 109 | 2536238 | 9 | ANO7 | CATCGCCAGCCTCACGGGGTCTGTAGTG AACCTCGTCTTCATCCTCATCCTCTCCAA GATCTATGTATCCCTGGCCCACG | 0.000173296 | 0.024766753 | 2.94E-05 |
| 1491 | 2536242 | 3 | ANO7 | TCTTCCATTCGAGCTTTGATTTGCAGCAA TTCCTCCCACCACCGGCTATTTCCATCGC CCAGCCAGGG | 0.012572419 | 0.006741049 | 3.26E-06 |
| 321 | 2536250 | 4 | ANO7 | AGAGTATCCTGTTTGGGAAGAATTCCCA TTTCAGGCACCCTCGATGAAGAGCCAGG CCAGGAACATGGGATGAGAGAGCGAAA TGGTGGAAAAAGGGGAGATAGGCTAATT CCAGA | 0.000142667 | 0.018967199 | 1.42E-05 |
| 1449 | 2536358 | 2 | SEPT2 | AGATGCATGATCCAGCTGTGTGTTTTCA ATCCTTGGGAGGGTGCCATCCACATTTT AACAGTACCTGTGCCTGA | 9.99E-06 | 0.009644912 | 8.09E-06 |
| 1198 | 2537304 | 1 |  | TCAGTGAGCTGAGCATCTGCATCTCGGG GTTCTGTTGTACATGGGGTTAATACTCCA TCCGAGTGAGCTGGGCATCCGCATCTCT GGGTTTTGTGTGCGTGGGGTTAACACTC CATCTGAGTGAGCTGGGTGACTGCCTCC ATGAGTCCTGTTGTG | 0.002329878 | 0.00823596 | 5.31E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
| --- | --- | --- | --- | --- | --- | --- | --- |
| 768 | 2537460 | 5 | SNTG2 | TCAGAACCTACAGCCGTGCGTGGGAACC CTCAGAGCTCACCGTGCTCCCATGAGCA GGCAGTAGGAGCACCCCCTTCAGAACCT AGGAACCCTCAGAGCTCACCATGCTCCC ATGAGCAGGCAGTAGGAGCACCCCCTTC AGAACCTACAGCCATGCCCGGGAACCCT CAGAGCTCACCGTGCTCCCATGAGCAGG CAGTAGGAGCACCCCCTTCAGAACCTAT AGCCGTGCCCCGGAACCCTCAGAGCTCA CCGTGCTCCCAGCTCCTCCACGAGGGCA GAGTCCTCTGTCTGCATCCAGCTGAACC CTGA | 0.000192114 | 0.010858597 | 5.00E-06 |
| 803 | 2537866 | 8 | MYT1L | TCTTGCCCTGGGTAGCAATCAGGTGGTT CATGAGTGGTGCCAACCAGTTACATTTC CTGATATGCAATACAGCTGGCAGCA | 0.021197932 | 0.006898528 | 6.62E-06 |
| 502 | 2538478 | 1 | | GTTTGGGCGTCATCAACAGTACTTCTATT TGTAAAATGC | 0.000173296 | 0.013636136 | 1.07E-05 |
| 1472 | 2539249 | 5 | RNF144A | GCAACCCAGCGTAGGGAAGAACTGCTTC TGGACTGCACCTGAGGCAGCACCACCGG CAACGGAGCCCCGCCACCTGCTGTACCC GTCCACCTTCTCTGGTTGACCTCCCTGGG GCCAGACAGCCCACTCAGAGTCCGTGCT CCCTCCTATGG | 4.58E-05 | 0.00662945 | 5.00E-06 |
| 162 | 2539540 | 4 | KIDINS220 | GCTGTCTCTGCTTCCTAATTAATTCACTT TTTTCAATTATTTAGTTATATTACTATGG ACTCATGGAAATTTATTTTATCTATGAGG CATAATCCAGTAAGATCATTAGTTATTTT GTTGATTAAACTATTTTTTTGTGATTTTTT TGAACAACAAAAAATGTAAACAATTGTA ACTGTATCCAGAGCAAGGAGACTGGTTG AGGAATAAAAGCATTTGAAAGATAGAA AAGATAAATATGACTCAGCAATAAGAAG AAATGAAGGACTGGCATGTTATGACATG GTGGACCTTGAAAACATTATGTTAAGTG AAAGAAGTTGGAAAAAGGAAAATAGGA AGTTATAAGACCTGATAAGTTACAGTTC TGGTTCAGGTTTACTACTAACTAGTTATT TGTTCTGTGACTTTAAAGTCCTGATTTTG ACCAGGCTGATGCACCCTCTAAACCACA ATGAGCACATCTGTGCTGGGAAGATGCA TTTATC | 2.33E-06 | 0.018153181 | 1.91E-05 |
| 258 | 2540638 | 5 | GREB1 | CTCCTTCTATCCCAATCGGACAGTGATAT GACCCTGGGGATGTTCCATGAATCATTT GTTCCTCTTTTGGCCCCATCTGATTGTGTA CTTATCTCCTTACACAGTCCTTCTGACCT TGAAATGATCCAGAAAAGATGTAAAAG AGTAAATTCTATAGTCAGTTTAAAAGGC AGCAGGAAAGGATTGGGAAGCATTTTGG ACAAGGGGTCTAGGAGACAGGCCCAGCT CTGCACTTTTCCGTGGGACAAAGGCCTTT GCATTCTCTCCTGTA | 0.004267545 | 0.016181776 | 1.93E-05 |
| 278 | 2542638 | 8 | AC013400.2 | GAGGACTGGCTGACCCTTTCTTATACAT GAGGAAGTATGAGTAGGACTGGGGCAG GGGCTTGAGGCTGTTAGAAGTCAGGGGA AGTTCCTAACTGAGAAGCTGCACAGAAG TGATGGAAGTCTCATTTGGTAGACTCAG ATCTATTGGGAGATTTGGTCCTGTATTAG TCCCTTC | 0.00877735 | 0.010171152 | 9.08E-06 |
| 182 | 2543788 | 8 | KLHL29 | TCACGGAGGACACAAACTCACCACTGTT CCT | 1.26E-06 | 0.021121055 | 2.52E-05 |
| 722 | 2544499 | 4 | ADCY3 | TGGCCAAGCAACATCTCGAGACCTCTCT GTCCTGGGACTGTCTCCTCAAATTCAGA GCCGGTCAGCATTGACTGGGTGACCTGT ATACCAGGGAGAATGCTTTTACACACGC GCGGAGCCCCCCTAGGAGACTGCCGATT TTATGT | 0.000333956 | 0.012620568 | 6.33E-06 |
| 911 | 2545313 | 1 | | AGATATTGTTGCCACCTTCTCCACACTGC TGTGGGAGTCCATGGCATCCCGTTTGAC CCTAGGAAATGTACCTG | 0.001054975 | 0.009808729 | 6.93E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 721 | 2545500 | 4 | CGREF1 | GCCAGATGGGGATGTTCCTGATCTCTGC TAGACCATCAAGCATCTGACGGTTTTTCT TTCTAGAGATGGGCTTGGGGTCTCATGC CTTGGCTTTGGTGGGCTTCTGCTTCCTCA GGAACTCACACTACCTGTACATACCCTG GGACTCACCAGAAAGCTTTAGGCTCTGT TTGATTGGTCCATTCTATCCTTGACTGTT TTCATATACTCAAGTGGTTGATTTTGCCA ATGGGCCTAAGCCATGTCAGTCTTAGGG GAAGTTTTGTTTTTCCTTTATAGTGGG TCTAATTTTCCTAACTGCATTTAGCAAAT AGCAATTCCTGGGGCCACTGTTGGTCTG ACCCTGATTTA | 0.008310486 | 0.008345871 | 6.14E-06 |
| 1808 | 2546680 | 5 | LBH | CTGAGCGCATCCTGGCTGCAGTTCTCTGC TCAATGTTTTCTTAAAAACATGTATTTT TCTTTTGCCTCATGTTTGTTTTCTTACCCC AAATGTTCCTTGCTTGCTTTGCACATGCC CCACCTCCCACCCACCAAGACCCATTGG AATCCCACCACTGCCTCTACTAGGCTGC CTGAGTTCAGATAATGATCTCAAAAACA GCACTCGCTCCCCTCACCCACTAACCCCC TGGCTCTAAGCAGCTTCCTTTCTCAGAGG GCCTTGCAAATTGTCAGA | 0.000150908 | 0.00755128 | 3.85E-06 |
| 694 | 2548823 | 4 | ATL2 | GAATTCAAGGATGTTCCAGTCCCTGGAA CATGGTATAGTATTTGCATATAACCTATG TGCATCCTCCCGTACACTTGAATCTCTAC ACTATAATACCTAATACAATGTAAATCA TTGTTATACTGTATGCTTGGGGAATAATG ACAAGAAAAATTGTACATGTTCAGTAC AGATGCAGTTAAATAATTTTTCTATTCCT GGTTGGTTGAATTCATGGATGTAGAACC CATAGATATGGAGGGCTGACTTGACTGT ATAGTGCATTGGCTTTTCAAACAGTAAA TCTGCAAAATCTAACTTGGGTCTGTTATG C | 0.002912998 | 0.009530356 | 6.26E-06 |
| 1266 | 2552574 | 1 | | TGATTAACATTAGAGATGGTTCTGGAAG GGTGAGTAATATGCCAATAATTAGAATA AGGCAATGGAGGGATGGAGGAATTGAT CATTCAGAGAAAGATATTCCCAATGGAG AGATACACGAAGGCAAAGGTAAGAATA AG | 0.016649629 | 0.007187407 | 7.40E-06 |
| 2053 | 2555538 | 3 | XPO1 | CAGGCACCTCTGACACCAAGTTGTGTGG ACAGCTTAAAACCCTACTCCATGGCATT GGGCTTCTAATGGGACAGCACTCAGTTT TTATTTACAATGGAAAATGTTATAATTCT GGTCCTTTTTTAAGTTTGAACAGAAGGG TTGATCAAAATGTGTTTTGTCTGTTTTAG GCTTGATGATTCACGCTTCTCTTTAAACT GCCTTAAAGTAATAAATACTATGGCATT CTGTTTAATACACGAAAGGTTTCCACTTG ATATAC | 0.001173835 | 0.007493161 | 3.61E-06 |
| 1439 | 2556553 | 1 | | TCGAACTCACCGTCCTGTACTCGAGTGA CGCACAGACACCCCCCGCCCACAGCCCA GACGCCCCCTCCCTCGCTGCCACCCCGA CCCGTCTCGGAGCTGGACTGGGTGCCGA CTTCTTCGCAGAAGG | 0.001280802 | 0.006668129 | 4.29E-06 |
| 293 | 2556767 | 4 | SPRED2 | TGGCTCTTGGTCTGGCCACTCACTATTTG TGAGATCCTGGCAGGAGTGAAACTTCAG TTTCCGGAGCCTTCACTCTATCCTTCTCC TGTCCGCATCTC | 0.000188103 | 0.013452402 | 9.14E-06 |
| 897 | 2558656 | 4 | TGFA | GGGAGAAGACAAGTAGCTCTGGTTCAGA CTGGGCCACAGCCCAGGCTCTGTCACTC AGAAGGGCCCTCCTCGAGGAGCAGGAG CAAGCTAGTGGGCTGCCA | 0.02996467 | 0.007536374 | 5.60E-06 |
| 1414 | 2559989 | 9 | DCTN1 | TGCCCTTCGTGCAGAGATCACAGATGCT GAAGGCCTGGGTTTGAAGCTCGAAGATC GAGAGACAGTTATTAAGGAGTTGAA | 0.037954575 | 0.006518274 | 3.07E-06 |
| 1229 | 2567271 | 4 | CHST10 | ATGTCCCTGGCTGTGTCAAGGACTGCCC GATGTCCTACACCTCCTG | 0.001429788 | 0.007566499 | 4.27E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1634 | 2570887 | 4 | AC068491.1 | CAGATCTCAGCTGCCGAGTGGAAACCCC ATTCTCACACCATAGCTATGGGACTGGG GGAAAGGGGAGGAAATAACTAAAGAGT AAGGAATTGGGGGAGGCTTTGAGGTTTG GATGTGACAGGTAGTTTGCATGTAGTTG GAATGCAGTAACATTGGTCCACAAGGTT | 0.001219026 | 0.008462262 | 3.38E-06 |
| 1058 | 2571158 | 6 | | GTGTCAGAAAATGAATCCCTCCTGCCTT ATTCCATTGTCATATCCCTTTGGGATACT AAAATCTCGGGGAGGGAAAGCCTATGTA GTTACAAATGGAAACTTCTCTTTCTTCCA TTCATTTTGGTGGGTGGGACAAAGGAAA AGAAGGTGAATATATATGTGATTGCGAA GCAGGAAGTCTGCATTTGTGTGTGAACT CCCCAAGTGATTCCCACGTGCACCTCAC TGTCCTTTCCCTACCCTACCTCATATACT TAATATGTCCTTTTAGTCTCCCAAG | 0.00022254 | 0.008954674 | 6.74E-06 |
| 1477 | 2571255 | 7 | ZC3H6 | CGGCCGCCGCCGACAGGTGACGAAGTGG TAAAAACTCA | 2.01E-05 | 0.007653159 | 2.75E-06 |
| 114 | 2572052 | 1 | | GATGTGAATTGCCACACCCTTCTGGAAA GTTATGTAGCAGTATCTGCTAAAACTTA ATATTCACATATATTAGACTTAGGAATTT CATTTTGTTGAATTCTAAAGACATAAAA ATACTGATGTCGGAGAAATCGTGATTCT GAAAGATTTTAAAATCAGAAGATTTAGA AATACATTGTTTGTTCCCAGTGCCACTAT GGCCAGGTAAATCTCAGGGGCTTTCTTA GCCCAGAAGG | 0.000364196 | 0.019834692 | 2.14E-05 |
| 776 | 2573159 | 5 | AC069154.2 | GCCACGCTGTGTGCAACCACTGCCACCC ATCAAGGGTATATTGAGCAC | 0.000205715 | 0.0076573 | 4.39E-06 |
| 903 | 2573284 | 1 | | GCGCCACCTGTAGCGAGTTATTTAAGGA GAAGAGCTGGGCTTATGGAGGAACCGTG GAAAGATCACAGGCTATCTTCAGAGAAG CTGCTGGTGGAATTCCCAAGTCCTTACTG GGTTTGGGGCTTGATTACCCACTCAGTG CCCAGCTGGTCATCATCATGTTGGCCAA CCACCAGAGGGGA | 9.46E-05 | 0.009345976 | 3.05E-06 |
| 812 | 2574817 | 9 | MAP3K2 | AGAGAGCTATCCAAAATCACGAATGCCT AGGGCTCAGAGCTACCCAGATAATCATC AGGAATTTTCAG | 0.000425014 | 0.013698999 | 8.31E-06 |
| 1592 | 2576618 | 6 | | AGTCCCGCTGGGCCCTAGACCAAGACAC GGGAGAACCTGTGACCCACCGCCCCCTG GTTAGGGCACAGAGGATCCACACCTTGC CGTGCCCTGGACTACAGCACGGAGGGAC CCCGATCTGCCGGGCACTGGGCTCCTGC ACAGAGGAGCCCCTGCCATGGAGGTCTG GACTGTCCTTGCCCCACCGCACCCTGGA CTACTGCACGCCAAGACCCTCGCCTGAA CGCGCCCTACACTCTGGCATGGGAGAAC CCTGCCCCGCAGAGCCCTGGACTCCGCC ACTGGAGGACTCG | 3.46E-05 | 0.008938034 | 4.32E-06 |
| 1985 | 2576850 | 6 | | TCATCATTTTGTTGCAACCCTCCTGACCC GGCGTCTCAA | 3.58E-06 | 0.006932694 | 7.40E-06 |
| 830 | 2577477 | 5 | MGAT5 | AGCTTCTTTGGTTACAGGGATTTTGTGGA CTTTTGTGAGCTGGCAGAGCAGGACAGG GTAACCCACCTGGACATGAGATCAAGCT CGCTGGTCCCTCTCAATGCTGTCTGATGT TGCTG | 0.002388272 | 0.007909049 | 6.65E-06 |
| 1839 | 2577916 | 9 | MCM6 | GACGTGCGGGATCAAGTTGCTATTCATG AAGCTATGGAACAGCAGACCATATCCAT CACTAAAGCA | 3.19E-05 | 0.009421871 | 2.84E-06 |
| 795 | 2577927 | 9 | MCM6 | ACTGATTCGTCCTGAGAGAAACACATTG GTTGTGAGTTTTGTGGACCTGGAACAAT TTAACCAGCAACTTTC | 1.29E-05 | 0.013004413 | 6.45E-06 |
| 675 | 2579064 | 4 | LRP1B | GAGATCTTCACACATGTTAAAGAAGCTT GAAAACAATGAAGAAAACCAGGGGA GACCGTTAGAGAGGGAAAGACAGAG ATGAGAGTGGTAGGGAAAAACAGTGAG GGATCAGAGCAGCACCCTGAGAGCGCAC CTGGACATCAGCCATTACACGTGAGGGG GAGGAACTTTTCTGAGTTTCCCTAAAAG | 0.016903952 | 0.007936997 | 7.43E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1368 | 2580293 | 5 | ACVR2A | GCTTAAAGTAAGGGGTTGTTGGGTGGAC CACACATGACATATTA TTTACTGAAATAAGCCATTCAATCAATG GGCAATAATCCTTGGATATAAATGCCCA GGCTTTGCCACCCACTAGGGTGACTCTA AGCCAAGTCACTTCATCTATGAATGCC | 0.001709174 | 0.007527767 | 3.54E-06 |
| 1127 | 2581981 | 1 | | GCCCAAGTGCCCCTACACCAGAGCACCT CTTGCTTTCAGCA | 0.001070147 | 0.011265964 | 9.12E-06 |
| 1097 | 2582242 | 3 | AC021849.1 | GTGCCATTGCTCCACCTGAAGTCACTGT ACCAGCCCAGAACACTAGTCTGGGTCCC AAGAAGTCATTT | 0.010636495 | 0.006584575 | 2.40E-06 |
| 677 | 2582451 | 2 | CYTIP | GGAACATTCCTTTCCACATCGCCTGAGTC TGACAGCCCGGATCAAAAACAAGCAGG CTTTGTGTCAAGACGTGGCACGTGTCAG AGAATTTGA | 0.0015655 | 0.011798932 | 1.18E-05 |
| 1739 | 2587120 | 1 | | CTGCCCTGTGAGGAGCGACCATTCTGCT CCATCTGACTCAAGACTCGGGATTATTTC AGCAGCTTGGATGTCTCAGGGCCTATCA CCCAAGAGG | 0.000260166 | 0.006806629 | 3.86E-06 |
| 194 | 2587539 | 4 | SP3 | CATGTATCAAGGGGAGCCTGGACTCCTG AGGCACTGTCATGATCACATCTCCCTTAC CAACCTGAATTGGACATT | 0.009861702 | 0.012931293 | 1.26E-05 |
| 1176 | 2589145 | 3 | PDE11A; AC011998.1 | AGGAAGCTCTGTGATAAAGTTGCCCTTC TTTCTAATGTGCTTCAGCATCATTCTTGG AATTTTTATTTGTTTGTTTGTTTCTGATGG AGATTATAGTTTTGTGACAGCTAGGCCC TTGTCTGTTGTTTCA | 0.019718284 | 0.011752117 | 1.04E-05 |
| 1794 | 2590293 | 1 | | CCTCTATCATGGCAGGGACTTCCCAATA AATTCTATACTCATTGTGGCCAGCTGAA CGCCTGACATTTAGTAGACTCCTCAAAA ATGATTTTTGAATGAATGATGACTGACC AACTGAATGAATGACCAATCTTAAAGCA CCAGTGAATGTTTTTACTGTCTTCACAGA GCTCAGAATAGATCCTTGGAAGCCATTC TGGAAAAGGGCAACTTTCCAAGGATGTT TTCAAAAAGACCAACATATAAGCACGTG TATTTGGTTGACCCTC | 0.004699102 | 0.007499753 | 4.42E-06 |
| 1734 | 2590313 | 4 | AC009478.1 | TGGCCTCTTTTCTCACTACAGCTTGTCTT TCAGTTCCACAATCTAAGGAGGATAATA GATAGCCAGATTTTATTGGTCCCAACCA CATCGTCTTCCCCACAAACCAGCAGCTC ACTCACTTTTCTATTTTTTACGTTGGCCA GATTAGAAACTTGTGTCATCATCATCATT TTCCCCTACCGTGTCTCAAAGATCTAGG | 3.34E-05 | 0.008654695 | 7.53E-06 |
| 1642 | 2590317 | 4 | AC009478.1 | CGCGGGTTTGTAAATAGAGTCCCTGTAT CTGCAGGTTTAACTGGTCAGTCTTTGACA GGCTTTTAAGCAAGGACATTTCAATGAT GTGAGGAAAAAAAAAGTGCCACAAAG CTTTGAGAATC | 4.52E-05 | 0.008749677 | 5.73E-06 |
| 179 | 2590322 | 4 | AC009478.1 | CTAGAATTAAGATATGCTGATGAGTTGC TTCTGCAGTTCAT | 1.05E-07 | 0.023171685 | 2.54E-05 |
| 1578 | 2590330 | 1 | | AGCTCTCAGGTTCGTGGGAAAGCTAACA TACAA | 0.007866301 | 0.00767295 | 6.39E-06 |
| 1656 | 2590333 | 1 | | ATGACTGGAGTAAGAAGAGTGAAGATTC CCTCGATGCCACACC | 0.000194662 | 0.008938714 | 7.05E-06 |
| 228 | 2590342 | 4 | AC009478.1 | TTAGCATTTCTGTGCAGACAGCTTTTTTG CTGTTCTTGGTCCTCAGCAATGACAATG GCTCCGAGGAGAT | 5.66E-07 | 0.021717658 | 1.52E-05 |
| 1524 | 2590346 | 1 | | CTGATATCGGAAGTGGAATCCTGCAGGA AGAGAAAGTGGGGCAAGGCCGAGGGCA TAAATGTGTGTTTCGAATGAGAAAAAAC AAATTGCTTATTCGGACCTCTAGCAACT GCCAATA | 3.04E-05 | 0.009745903 | 8.95E-06 |
| 477 | 2590349 | 1 | | ATGGAATATGGAGCAAAAGGGGTCCTGT GCT | 1.31E-05 | 0.015351436 | 1.07E-05 |
| 1108 | 2590723 | 9 | FRZB | CGCTGGGATATGAAGCTTCGTCATCTTG GACTCAGTAAAAGTGATTCTAGCAATAG TGATTCCACTCAGAGTCAGAAGTCTGGC AGGAACTCGAACCCCCGGCAA | 4.39E-05 | 0.00810083 | 4.99E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 836 | 2591456 | 4 | TFPI | GGTGACTGCCTGTATCAAATCTTTACTGCCTTTTTCAAATTCTTACCATTTTTATAAAAAGGAGTCACACTACTCAATCTATACATCAGTGTTAAATATGATTTTTACTAATTTTTTTTTTTTTTTTACCAACACTATCTTAAAAAATCTGACAGCATAGAGCAGTGATTAAAGGCATTTGCTTCAGGGTCAAATATAGTTACACTGCTGTTTTTTGGACAATTTGTTATTTTGAACCATTGTTTCTTACCTTTATAAAATGAGCATAAGATAATGTTCTTTTAAGGTGAGTATGAGATACAAATGAGAAAAGCAATAATAATAAAGATTCAACAATGGAAACTGCTATTTACATTATGATTGTTATAATTAGAAGGACAAACTGTAATTTAACGTTCCTATAGTAATAAAATGGCATCTACAGAGCAAATCTAAACAGACTTAATCTTCATATAACAATTCATCCCAGATAATTTGAATTGACCATAATAACATGTTGAAAGGAGGCTGAAATAAAACAGGGTTTGCTCTTTTCAACTCTTTAGCCAAGACTTTTTTAAAAAAAACTGGTATATAAATGCTTTGTATTTCCTTTCAAGTTTGAAGGGAAAATAAATATAATACTTAATAGATTTTCAAGTATCTCTTTAGACATTCTCTTGTTTAGGCTTGTACTAATCCATTCATTCAGGGTTTGACTGTTGGGTGAACTTCTTTGCCCTATTCCCAGCTGTGAGAGGCAATTCTCCAGGTTTCTAAGCTTTAGACCTACGCCCTTCTCTGATGAGGTTAATTAGGGTTTGGGCTGAAACCCAGATTCCTATATATGTGGATAGAGTGATGTAGAAGTACTTTATGATAATAAATATAAATGAAATTTAGATTTTAATTTAGAAATAGAAAACATTTAGGCAACTCACTGAATCAAAAATAAATATAGACAAATTTAATTAATATATTTATTTATTATATTTTCCTGGGTTGGGCTTTGGCCTCTATTTCATATATTTTGTTTATTTTTCAGGATGTTCTGGGATAATGTAGTCCAGGTTCTAGTTCTGCC | 0.009724683 | 0.007478175 | 2.86E-06 |
| 2062 | 2591636 | 5 | COL3A1 | GGCACTTATGCATGTTTCCCCAGTTTCCATATTACAGAATACCTTGATAGCATCCAATTTGCATCCTTGGTTAGGGTCAACCCAGT | 0.00028925 | 0.007114892 | 8.20E-06 |
| 345 | 2591688 | 9 | COL5A2 | AAAAGATGGTGAAGTTGGTCCTTCTGGTC | 0.000442481 | 0.007495535 | 6.23E-06 |
| 1066 | 2592274 | 4 | STAT1 | GCTGAGGTTTAGCTGTCAGTTCTTTTTGCCCTTTGGGAATTCGGCATGGTTTCATTTTACTGCACTAGCCAAGAGACTTTACTTTTAAGAAGTATTAAAATTCTAAAATTCTATTAATCTCTCATTAATAGTATTTAATATAAAGATTCTTAAAATTACTGACGTTATGAATTGGTTTGATGC | 0.000449203 | 0.00766067 | 5.93E-06 |
| 1338 | 2592645 | 4 | TMEFF2 | AGAAGAATAATGGAACCACTTTGGAAATAGG | 0.014482591 | 0.009295027 | 5.86E-06 |
| 118 | 2592648 | 9 | TMEFF2 | GGAGACATCCACCTGTGATATTTGCCAGTTTGGTGCAGAATGTGACGAAGATGCCGAG | 0.013588933 | 0.024063565 | 2.28E-05 |
| 535 | 2595779 | 1 | | AGGAAGCCTGGCCGAAATGTGCTTTTGGATAAAATGTCCCGATTAACCAAGAGCACACAAAATGTGCAGAC | 6.19E-05 | 0.010523583 | 4.82E-06 |
| 1974 | 2597276 | 2 | C2orf67 | GGAGGAAATAAAGCCCTGTTCTGGATCCCCCATCCCCTCCAGAATAAGAGCATGTTCTGCATGTATTAATCTTTTATGCTGTTTATGAAACAGGCAAGATAAGTCTGTTTTTCCTTCTGGAACCATAAGGGTAACCAGATTTTCATCTACAGACAAGTGGTAGTCATTTGTGTTTATCATGCAACTTACTTACAAACACCAAGATATTAATTGCTGCAACTTGATGTCAAATCACATTACTGGGTAATTTTAAGACTATGTACCCACACCATACATACATACATATATATATACACATACATACAAACCTGTGTGCCAAGTGACAGCTATTTTTTTATA | 0.035105592 | 0.006946012 | 7.83E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
|  |  |  |  | TACATGGTAATTCATTAAAATTGCCTTAGTAATATATTAGAATATACAAATATGTGTGTATAAAATAAACATACACACACACACACCCCTATGTAGTTTTTAAAACACTGGCAATGACCCACTCCCCTTGGAAATGCATGTATGAACTACCCTATGAAATGTAAGCTGCAGAATAGATAAAACACAGGTTTCCACTAATAAAAGACATCTGAACGTCCTGAATATAGAGACAGAAGTTTTTTGTTGTTGTTGTTGTTGTTTTAACATGTTTAACCAACAGAAGTTATTTACAGAAATTCATATATCCAGGCAACACAAAACTCCTTTATTCAAAATCACTGCTATCTTTGGGACTAAACACAGGCTACTTTC |  |  |  |
| 781 | 2599275 | 4 | TNS1 | TGGGACAAACAGCAGTACCTCCCTCATCAGGTACTGTGGGATTAAATGAGATTATATATATATATGCTGGGCTCCAAACAGAGCCTGATATATAGCAAGCATTCAGTGAATCTTAACCAGCATCATTGTGATTCCACACAGGAGCCCATCTGCTTGAGGAATTTAGCTGTAAAAATAAAAGTTTGAACACTACTGGATGGGATGATC | 9.17E-05 | 0.008975208 | 8.42E-06 |
| 1632 | 2599476 | 2 | USP37 | TTATTTGCCATACAGTAACCAGAGACCTCCAACTAGGGGC | 0.029541528 | 0.006562388 | 4.64E-06 |
| 910 | 2599863 | 1 |  | GGCTTCCTATATCTCCCTTCCTGGTCAGCAATATAGCCCATTCTCTGGAGCTTCCCGTGGGGATTTTTCTTCCCAGTGAATTCTTCCTATTAGTTATCTAAGTGGTTTAACTGTTGAAATGTTTTCCGTCATCTTTAGATCCTTTTGAAACCACTTTCTCTACCTGCTTCAGTTCCATTTGATGACCGCCATCATCTTTGAGATTCCCATCCAGAACCATGCATACCTCTTAGGTTCTCACAGCCAGGAGCTATTTCCTAAGTTGTCTTTCTGGTGGAAAGCTCAGCTCCTACTAAGCAGTCCTTGCTTCAAAATGGCTTTGATGAATGACCCAAAGGAGCCAGGCCAGTCCCTGAGTCATCACAGAGCACCCTAGGTGAGAAACCCTGAAGTGTTCTCTGCTGTTG | 4.52E-05 | 0.008829888 | 5.90E-06 |
| 965 | 2599915 | 9 | C2orf24 | CCCATGTGCTATGATGCTGGCTCTGGTGTACATTGAACGGCTCCGGCACCGAAACCCAGACTACTTGCAGCATGTGTCATCCTCTGACTTGTTCCTGA | 0.000742232 | 0.007348425 | 2.98E-06 |
| 335 | 2600704 | 9 | EPHA4 | CATTGAGGAAGGCTATCGGTTACCCCCTCCAATGGACTGCCCCATTGCGCTCCACCAGCTGATGCTAGACTGCTGGCAGAAGGAGAGGAGCGACAGGCCTAAATTTGGGCAGATTGTCAACATGTTGG | 1.55E-05 | 0.018536235 | 1.63E-05 |
| 378 | 2600943 | 1 |  | TTTTTGAGCCACGATCACCGGAAGGGAGGAGGCTCATACCTCTGGCACGTCAACAGTGACAGC | 0.014566395 | 0.008784565 | 3.86E-06 |
| 1809 | 2601389 | 4 | WDFY1 | ACCCTGTGCATGTTCCGATGAAAGAGGGCCCCAGAGATGTGGTGTGGAATGATTTCCTCTGGGGAGCAGAAGGCAGAATTGCCATGCCCAAGCCCGAGC | 0.000306094 | 0.007084701 | 3.35E-06 |
| 154 | 2601681 | 9 | DOCK10 | TGAAGGCCATAAGCAGCACAGATCACAAACTTTACCTATAATTCGAGGCAAAATGCACTTTCTAACCCCAAACTCTTACAGATGTTAGACA | 7.88E-06 | 0.02628921 | 2.68E-05 |
| 1081 | 2602465 | 3 | 5S_rRNA.424 | CATAGTACTCTGAACATGCCCGATTTCATCTGT | 0.000144203 | 0.007318832 | 2.05E-06 |
| 1234 | 2602539 | 4 | SPHKAP | CGCTCTAGTCAAGGGCCAAGCCCTTTGCCATCCCTCCTCCAGGGAGAACTGACCAGTCCATCCTTGGTGATAGCTGACCTGGATTGTCTTGGATCAAAGCA | 9.28E-05 | 0.008361255 | 2.05E-06 |
| 1157 | 2602918 | 9 | TRIP12 | TCCAGGGCCTGTTTGCGCTTCCCTTTGGTAGGACAGCAAAGCCAGCTCATATCGCAAAGGTTAAGATGAAGTTTCGCTTCTTAGGAAAATTAATGGCCAAGGCTATCATGGATTTCA | 1.47E-05 | 0.008997078 | 6.95E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 2061 | 2602948 | 9 | TRIP12 | GGATGATGCTCGAGCACAGCTTATGAAA GAGGATCCGGAACTGGCTAAGTCTTTTA TTAAGACATTATTTGGTGTTCTTTATGAA GTGTATAGTTCCTCAGCAGGACCTGCGG TCAGACATAAGTGCCTTAGAGCAATTCT TAGGATAATTTATTTTGCGGATGCTGAA CTTCTGAAGGA | 0.000753154 | 0.007525896 | 5.35E-06 |
| 396 | 2603204 | 1 | | CATCAGAGGCGGGATAGGCCCTCCCCCT GGCTTGGACCTTGGGCAGTTCCCCACCA GAGGCTGTGGAGGTCTCCAACATCCGGC AACATCCTTCCCAAGTGCCTGGCTCAAC CCTTCTGTGCCTGGGAGTTTTCTCAGATG CCATGGGGCTTGCAGGACTGCAAGCTG GAGAAAGAGAAACTCCCAACAGTTATGG CCC | 0.012720391 | 0.008693728 | 8.76E-06 |
| 723 | 2603264 | 5 | CAB39 | CTCTTTGACACATGGTGCTGCTACACCGC CCTTCATGGCAGGTCTGCTACTTCTGAAT GGGACATACCCTTCCACCGATGCATTAT A | 0.011153791 | 0.00928397 | 4.96E-06 |
| 286 | 2605670 | 5 | FAM132B; AC016757.1 | CAACAGGTTTCTCAGCTGCAGGGCTTCT CAGAGCCTGCAAGGGCTCCAAGTCAGGT GGGAGGGTGGCCCTTCCCCACAGGCAGT CATTTGGCAGAGCCTTCCGTGAAACCAG CACTCTAGCCTGGCTGCTCCAAACGTGG TCATGCACCAGCAGCGTGGTCATGCACC AGCAGTGTCACATTCCCTGGGAACTCCC AGAAATGCAGAATCTGGGATCCACCCAG ACCTGCCTCAGGATCTGCATCTTAAGAT CCAGGTGGGGCAGAGACCATCTGAGTTC ACCAAGCATGCTGTGTGGCACCCAGAAG GGACCTCTAAATGCCTTTCAGCAAGCAC AGACTCTGGGCCAGACAGCCTGGCCTCC ATTTCTGGCTCTGCTGTGTGAACTTGGGC TAACTCGGGGAGTAGCTCTACCTTC | 0.003288508 | 0.011313889 | 6.50E-06 |
| 788 | 2605785 | 9 | PER2 | CCAATGAAGAGTATTACCAGCTGCTGAT GTCCAGCGAGGGTCACCCCTGTGGAGCA GACGTGCCCTCCTACACCGTGGAGGAGA TGGAGAGCGTTACCTCTGAGCACATTGT GA | 0.000524526 | 0.009752043 | 4.77E-06 |
| 1004 | 2606698 | 1 | | GAGTAAGGTTGGAGCGTTCTCCCTACCC CCCTCCTGTGCGGCTAAGAGGGTGCTGA CCGTCTCCCCTGGGCCTGGTGACCAAGC CAGCCTTGTCCAC | 5.32E-05 | 0.011144864 | 8.01E-06 |
| 1695 | 2606919 | 9 | KIF1A | TGACCAATGCCCTGGTGGGTATGAGCCC CTCATCCTCGCTCTCAGCCCTGTCCAGCC GCGCGGCCTCCGTGTCCAGCCTCCACGA GCGCATCTTGTTTGCCCCGGGCAGCGAG GAGGCCATTGAAAGACTG | 0.042209752 | 0.006760359 | 3.63E-06 |
| 2067 | 2608200 | 3 | TRNT1 | GTCCCATCAATGACATGCTACCAGACAT ATCAGATTCCACAGGATAATGGCACCAA GCTACCCAAGTAGATGTTTCTGGTATTCT AGACTGCCGTTCATGCTTGTTTCCTAAAG TATACTTAAAAGTTTCAAATACAGTTTCA CTTAGAAACTGCAACCCTCCAAGTAATG TTATG | 5.06E-05 | 0.007942636 | 2.32E-06 |
| 1430 | 2608310 | 8 | SUMF1 | CGGAGCAGCCAATCCGCGCGCGGCCCAT CAGCTGACCGCCTTTGCTTACA | 0.000664925 | 0.010575278 | 7.69E-06 |
| 1942 | 2608320 | 4 | LRRN1 | TCCCTTTAGCTCACCATTATAGATGCTAT TTTTATACTTATATTCAGAGGTTGCAAAC TGGCCATGGGCCATAAAGGGACTCTGAA AGCAGGTAGGTTCTGTTTGGCCTGCACA GCTAAAACATTTGGGTTGCCTTTTGGAA TTCATGCACTCTCCAGCCTTCTACATGAC TACTGCTTCTTACTGTGTTAGAATCAACT CCCTACACCTACCTGGCCCTAGAAAGCA TTAAGT | 0.006310467 | 0.007137097 | 3.69E-06 |
| 155 | 2608321 | 2 | LRRN1 | TGAAATAATTCATGCCACGGACCTGTGC ACATGCCTGGAATTGAGAGACACAGTTA AAAGACTCCAAGTTGCTTTCTGCCTTTTG AAAACTCCTGAAAACCATCCCTTTGGAC | 0.000173296 | 0.019550721 | 1.90E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1549 | 2608324 | 9 | LRRN1 | TCTGGAATTCTACACAGCTCAACCAAGA CTTTGCTTGAATGTTTACATTTTCTGCTC GCTGTCCTACATATCACAATA GGTGCTGGGCCTACTAATGACTTCATTA ACCGAGTCTTCCATACAGAATAGTGAGT GTCCACAACTTTGCGTATGTGAAATTCGT CCCTGGTTTACCCCACAGTCAACTTACA GAGAAGCCACCACTGTTGATTGCAATGA CCTCCGCTTAACAAGGATTCCCAGTAAC CTCTCTAGTGACACACAAGTGCTTCTCTT ACAGAGCAATAACATCGCAAAGACTGTG GATGAGCTGCAGCAGCTTTTCAACTTGA CTGAACTAGATTTCTCCCAAAACAACTTT ACTAACATTAAGGAGGTCGGGCTGGCAA ACCTAACCCAGCTCACAACGCTGCATTT GGAGGAAAATCAGATTACCGAGATGACT GATTACTGTCTACAAGACCTCAGCAACC TTCAAGAACTCTACATCAACCACAACCA AATTAGCACTATTTCTGCTCATGCTTTTG CAGGCTTAAAAAATCTATTAAGGCTCCA CCTGAACTCCAACAAATTGAAAGTTATT GATAGTCGCTGGTTTGATTCTACACCCA ACCTGGAAATTCTCATGATCGGAGAAAA CCCTGTGATTGGAATTCTGGATATGAAC TTCAAACCCTCGCAAATTTGAGAAGCT TAGTTTTGGCAGGAATGTATCTCACTGAT ATTCCTGGAAATGCTTTGGTGGGTCTGG ATAGCCTTGAGAGCCTGTCTTTTTATGAT AACAAACTGGTTAAAGTCCCTCAACTTG CCCTGCAAAAGTTCCAAATTTGAAATT CTTAGACCTCAACAAAAACCCCATTCAC AAAATCCAAGAAGGGGACTTCAAAAAT ATGCTTCGGTTAAAAGAACTGGGAATCA ACAATATGGGCGAGCTCGTTTCTGTCGA CCGCTATGCCCTGGATAACTTGCCTGAA CTCACAAAGCTGGAAGCCACCAATAACC CTAAACTCTCTTACATCCACCGCTTGGCT TTCCGAAGTGTCCCTGCTCTGGAAAGCTT GATGCTGAACAACAATGCCTTGAATGCC ATTTACCAAAAGACAGTCGAATCCCTCC CCAATCTGCGTGAGATCAGTATCCATAG CAATCCCCTCAGGTGTGACTGTGTGATC CACTGGATTAACTCCAACAAAACCAACA TCCGCTTCATGGAGCCCCTGTCCATGTTC TGTGCCATGCCGCCCGAATATAAAGGGC ACCAGGTGAAGGAAGTTTTAATCCAGGA TTCGAGTGAACAGTGCCTCCCAATGATA TCTCACGACAGCTTCCCAAATCGTTTAA ACGTGGATATCGGCACGACGGTTTTCCT AGACTGTCGAGCCATGGCTGAGCCAGAA CCTGAAATTTACTGGGTCACTCCCATTGG AAATAAGATAACTGTGGAAACCCTTTCA GATAAATACAAGCTAAGTAGCGAAGGTA CCTTGGAAATATCTAACATACAAATTGA AGACTCAGGAAGATACACATGTGTTGCC CAGAATGTCCAAGGGGCAGACACTCGGG TGGCAACAATTAAGGTTAATGGGACCCT TCTGGATGGTACCCAGGTGCTAAAAATA TACGTCAAGCAGACAGAATCCCATTCCA TCTTAGTGTCCTGGAAAGTTAATTCCAAT GTCATGACGTCAAACTTAAAATGGTCGT CTGCCACCATGAAGATTGATAACCCTCA CATAACATATACTGCCAGGGTCCCAGTC GATGTCCATGAATA | 0.000363271 | 0.011008854 | 7.59E-06 |
| 645 | 2608325 | 2 | LRRN1 | TGGTAGTAAGGAGCACAAAGACGTTTTT GCTTTATTCTGCAAAAGTGAACAAGTTG AAGACTTTTGTATTTTTGACTTTGCTAGT TTGTGGCAGAGTGGAGAGGACGGGTGG ATATTTCAAATTTTTTTAGTATAGCGTAT CGCAAGGGTTTGACACGGCTGCCAGCGA | 6.21E-05 | 0.019434045 | 1.39E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CTCTAGGCTTCCAGTCTGTGTTTGGTTTT TATTCTTATCATTATTATGATTGTTATTA TATTATTATTTTATTTTAGTTGTTGTGCTA AACTCAATAATGCTGTTCTAACTACAGT GCTCAATA | | | |
| 1008 | 2608339 | 5 | SUMF1 | TGAGCAAAACCACAGGCAGCAATCCTCA AGCCCATTTCTATTCTTCTGGATAAAAAA GACATTTTTTTTTTTTCAAAATATAGG GGATGTCATCTTTTTCCCAGCCATCTTGT GAGGGAAGAAGATAGCAAGACAGAAAT AACTCCTTATAATCTTTTCAAATACCAAA GCATTCCACTTCCCATGCAATCATTTTGA ACCTCTAACACGAGCAAAAACTATAGCT GTTATGGAGAAAAGAACTCTTAGTTTGA AAAGATCGAGTACTAGCATATAGAATCC CCCAAACCACTTTAAATTAATGAGTCAT ACAATATATCTGACATGTTACCAAATCC TCCCCAGACCCAAGGCTCAACAGTTTTT GAAATCTCAACACACATTTTCTGAGGAA TTGCAGTTTGGAATGAAACTAGGGCTTC TGGTGGAGTGATCTGTACAGTAGTCACA GGATGGTCCTT | 2.54E-05 | 0.012507145 | 5.22E-06 |
| 1746 | 2608671 | 9 | ITPR1 | GGAGTCCACCATGAAACTTGTCACGAAC CTTTCTGGCCAGCTGTCGGAATTAAAGG ATCAG | 0.000933891 | 0.006561627 | 5.98E-06 |
| 1597 | 2611429 | 1 | | AGCTGCTTCCTGTCAAGGCGCCCCAACT CGCTTTCCACCCCCCTTCTCAGAGCTGCT TTCTACAAGCATGTAGTTAAC | 0.000611594 | 0.007531947 | 4.72E-06 |
| 1532 | 2612685 | 5 | RFTN1 | GACCCAGCTCTGATAGGGCTTCTGAGGT GCCAGAAACCTCCAGCTGGAATATCCTG CCTTCAGGACACATCAGACATCTGGCTG TTCATTAGTCCAATGTTACAAGTCCTGCA GTCCACCTCCCATTCTATCTGGCTCCCTG CTCTACCAGAGACAAATCCACCAGAGCC ATAACAGATGCGCTGCCGGGTCCCCATC AGCATCTGCACTGAGACCTACCACGGGA CAAACCAATGATGAAAAACCCAAAGTCC AGAAAATGAAAATGGTCTCAGAGAGACT GGCCAATCCTATTTGGGGTCCTCTA | 0.000197241 | 0.007072248 | 3.46E-06 |
| 1419 | 2616182 | 4 | CRTAP | AGGAGGTGGCAAAACTAGGCGACTTTCC AAATC | 0.001052466 | 0.006830214 | 3.37E-06 |
| 916 | 2617484 | 9 | DLEC1 | TTCGGGAGCTCTATAAGCAGCGGCTGGA TGAGTTTGAAATGTTGGAGAGACATATC ACTCAGGCCCAAGCACGGGCTATTGCGG AAAATGAGCGGGTCATGAGCCAGGCTGG AGTACAGGACCTCGAGAGCCTT | 0.013431886 | 0.008587469 | 5.38E-06 |
| 816 | 2617540 | 9 | DLEC1 | GGGGCAGCAGTACCATCTACATCTCCTT CACCCCTATGGTGCTCAGCCCTGAGATC CTGCACAAGGTGGAGTGTACTGGCTACG CCCTGGGTTTCATGAGC | 0.017888918 | 0.007446384 | 3.41E-06 |
| 1694 | 2618614 | 2 | EIF1B | GGCTGCCTTGTGAAATGATTCCCTGCAG TAAACGGACTTTTCATTTATTTAATCATT CAAACTTCCATTCACATCTGCATGATTAC AGAAAACATGGGGTATGTAGACTAGTAA CACATAAGAAAATTGCAGTAAGATGGTA ACAAAACCTCATATTGTCTTTACATGTTT CCAATGGAAAATGTTTTGAGTGTTTATTG TTCAGTTATTACGTTTCACTTGATTAAA TTTTTTTGTTGTTGTATTAAACCATGTAC GTTGCAGCTTAACAATA | 6.41E-05 | 0.006862005 | 2.47E-06 |
| 98 | 2619175 | 9 | TRAK1 | GCCAATGTCCAGATTGCTAGTATCTCAG AGGAACTGGCCAAGAAGACGGAAGATG CTGCCCGCCAGCAAGAGGAGATCACACA CCTGCTATCGCAAATAGTTGATTTG | 0.004114217 | 0.025408058 | 2.25E-05 |
| 269 | 2622081 | 7 | RHOA | GAGAGACTGAGTGCCACCCATGAGAACT GGTGGCTCCTCTGGGAGGGAACCTGGAT ACAGTGAGGAGAAAAGAGCACTGTGAA TTAGAGCCAGATGCTTAAGTCCAGGTGA GACAGGTTATGCCATCTTCCAAAGTGTC TAATTGCCTCAGGCGTGAAACCAATTCC | 2.76E-05 | 0.023574859 | 3.36E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TATTTACTTAGCCCAGCTCCATGGGTAC TGAGATACATGGGGCCGAAAAGGGGTA ATATGGCCATCTTTTATCAGAAAAAGTG ACAAAACGGGAATTTAAAAAATGAATTT TCCATCTGACTTTATTTCCAAATACACTT TCTTTTTTAAAAAACCAATACACTTTCTT TGAGGATGACAGTATTAGGAAATCCAAT TATACAAAAATACTACATCTAGTCTGG GGTAGATATAATTTATTTTTGGTAACATAC ATTAAGTGGCACTAATTACACAGTAACT ATAAGGTAACTAACATGAAACCACAGAA CTGTAACTCTGCCACAGCTGCATGAACT TGGGCTTTTCTGGTTGAGCCCATTTTCAA AAAACTGCCCACCCCAGAGCTATGCCAA CAAAATCTGTTACGGAGTAAAGCCCTGA AGTGGTGACTCACCAGAGTACCTTGCAG CTGACAGATAATAGGCAGGACATGTTAG TTATAAAGTAGTTACAGCCTAATTCACA AAAGTTACCAACTGTTTCTCTTTCTAGAA AGAAGCAAGAAGTTAAGAAATTCCTTGA ATTAGCGCCTGGTGTGTCAGGTGGGAGT GCAGAGGAGGGCTGTTAGAGCAGTGTCA AAAGGACCCTGGTGGGCCAGACGGGTTG GACATCGTTAATA | | | |
| 545 | 2623385 | 5 | IQCF1 | CAATTGGAGTCTAGCAGGGAATACCAGA TCAATTTAAAGCCTAAAATCAAATAGCT GCAGGATTTGAGTCAATATTTTGTTGAG AGACAATTAATAAAAATATAGATTGAAT AAACTACATATGCTACAACCAACAGCGA TTTATTAACTACACTAGAGATGGTGTTA AAGGAATAGCTGAGCAATTAGGGGCTAC TAGCCGGATGGCTTGGGAAAATAGGATA GGCTTAGACATGATAATAGCAGAAAGAG GAGGAGTTTGCCTCATGATTAAAACTCA ATGTTGTACCTTCATCCCAAACAACACT GCCCCTGATGGAAGTATAACAAAGGCAT TGCAAGGTCTGACTGCCCTGTCCAATGA GTTAGCCAACAACTCAGGGTTAAATGAG CCCTTTACAGGATGGCTAGAAAAGTGGT TCAGTAAATGGAAAAGAATTATAGCCTC AATTCTCACTTCCCTGGCAGCCGCAATG GGTGTATTTATT | 0.00071035 | 0.008401967 | 6.10E-06 |
| 690 | 2626663 | 8 | FHIT | CTGGCAAGGCATACCGCCTGACCTGCAC AC | 0.007866301 | 0.010201017 | 7.71E-06 |
| 1156 | 2627422 | 9 | ATXN7 | CTACTGAAATCTGCGGTGGGGCCAACCT GTCCTGCTACTGTGAGTTCCTTAGTCAAG CCTGGCCTTAACTGCCCCTCAATACCAA AGCCAACCTTGCCTTCACCTGGACAGAT TCTGAATGGCAAAGGGCTTCCTG | 8.27E-06 | 0.012122322 | 1.25E-05 |
| 651 | 2629053 | 5 | FOXP1 | TGCTAACCCACGATCAAGGTCATGGGGT CAGATAGTTATTCAGTGTGGCAGAGACT CTTTCCTTGCCCATCAGAATGGAGGGAA AAGAATATTACACAGAAATCAAAGAAG AGCTTGGAAGGACACGTATTTCACAAAT GCATTGATGAGTAAGAGAGAAAACTTAT CCAAGGCAGTGACAAGAGACTCCTGAGA CAACTGGCACA | 0.000436951 | 0.011217143 | 6.81E-06 |
| 409 | 2629551 | 7 | RYBP | CGTGCACATGCCAGTAACAGGAATATAT TAACATCTTTTATTTGCTAGACAAAGAG CAGTGTCCAATATAAATTTCCCCCAAAA CATTTAAGACCTGTGAATTTTTGACCAGT TCACAAAACCACCAACTGACACTTTAGC ATGAAGAAAAAAACAAACCTAACAGAC TGTCAGCTCTAAAGACATTACAGAGCAG AAACTTCCAAAAGCGTTATACAAGCTGT CTTTCTGGGCAAATGAAAAATATAGCTC GTATAATACATTAACAAAATTCACAAG ATAAGATTGTTTTGACATACTTAACAAG CATTCTCTATTTGTCTCCAACAAACAAAG CTAAGGAAATAATGTAACCATCTTTACA | 0.001173835 | 0.015072362 | 1.96E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CAGTAAATTAAGGTTACAAGTCATACAC AAGAACAGAACTGCTTGCGCATTAAAAA CTGTTCAGCTCCATTGTCATACTCTAAAT GTTGGCTCTTAAACCATTTTCGGTTACAT ACAAGCAAAGGTTATTATATATTCAGCA ATTAATAAATTTTCAATAATTTAAGATAC GGTAGCTTAAAAAAGTAGACTGAGAATG GTCTTGATAAGGCAGGTGAAACATCTTA GTGGAACTAAACTCACAGAAGCTTCTGC CAATGTTTTTAAATATCCAGATTGAAACT GAAAGGTTTTGATTAGAATATTGTGTGG GTGTCAAGATGTCTTTTTTTTGTAACTG CATGACTCAAGCAGAGCAAGTCAGGTAA GCTCTGTGTGCGCGCACACGCACGAGTG TGAAAGATTGCGTGGTATTAAAACAAAT GGAAACTTGCAAGCGTAACACTGTG | | | |
| 738 | 2629744 | 4 | PPP4R2 | TGTATTCCACAATGGCCGCGCCATTTTAC GTTCCCATCAGCAGTGCCCATTGGTCCC AGTTTCTC | 0.04726916 | 0.008537673 | 9.19E-06 |
| 1410 | 2630507 | 4 | ROBO2 | TATGGTACTGTTAAGAACCCTGAGTTTG CAGTCATGTTATTTTCATTTTTAACAATT TAATTTAGAATTCAAAAACTTTTTATATG TTTTTCCTGATAAATAGTGCTTAAATTAC TTGTCAATATTCTGTTCCAAAGAATGCAT ACAAATTGGATTTTGTTTTTCATTTGATG TGTGTTAAGAGTGGAAAAGATGCATAAC TGACGTGCATCTGGCATATCTGATGTGC CGCAACTGCCAACAGTTCAGATAACTTT ATGGTGGTCACAGGTCAGTCATAATGA | 0.001302035 | 0.008310638 | 3.52E-06 |
| 1748 | 2635824 | 9 | PLCXD2 | TCTTATTTTCTACCACTGTCCCTTCTACA AGCAGTACCCCTTCCTGTGGCCAGGAAA GAAGATTCCAGCGCCCTGGGCAAACACC ACAAGTGTGCGCAAACTAATCCTCTTCTT GGAGACCACTCTGAGTGAGCGGGCCTCA | 3.62E-05 | 0.008886785 | 7.53E-06 |
| 1166 | 2636575 | 6 | | CCACACCATGGTTTCCCAATAGTTCTCTT TTTGGAGGACTTTTCAATTGATGAGTAA ACTGCTTTAGATATTTCAGAACTTCATTC CCCAAATGAAAGCTAATCTGGACAAACT ATATATTGCATAGATTTCTCTACAGATTC TTTGCTTTAAAACCTAAATGCAACTAAC ATAGTGTAATTTTAACCTATTTGCCCCAC AGTAAAAACTATCTGTCCTGAAAAATAT GATGGATATATCCTGTGATTTTCCAGTTA ACAGAATTGTTCTACTTCAAAGATAATT ATTATCATATATCAAAATAACCAGCTCA ACATAGGACATTACTTCAGTCTTTACTGA CTCATAGGCATATGAACTTGTGCCCAGC TTT | 0.002123679 | 0.009197633 | 9.18E-06 |
| 423 | 2638147 | 9 | C3orf15 | GGCAAAAATTCAGCGCACGCATGTATCA A | 0.009193693 | 0.007970185 | 8.90E-06 |
| 1233 | 2638761 | 2 | SLC15A2 | TGACTCCCTAGATTCTGTCCTGACCCCAA TTCCTGGCCCTGTCTTGAAGCATTTTTTT TCTTCTACTGGATTAGACAAGAGAGATA GCAGCATATCAGAGCTGATCTCCTCCAC CTTTCTCCAATGACAGAAGTTCCAGGAC TGGTTTTCCAGTACATCTTTAAACAAGGC CCCAGAGACTCTATGTCTGCCCGTCCA | 0.000352341 | 0.00718282 | 1.84E-06 |
| 1834 | 2642793 | 4 | DNAJC13 | GGCAGCTTATTCACGTGGCCTTTCCTCCG CTGCTGTGATTTTATCTTTGAATGTGGCC TTTGGAGTGGGTAAAGTAGGACTTAGAC GCTCAGTGAAGTGGCT | 0.045938047 | 0.007033282 | 3.08E-06 |
| 184 | 2643246 | 4 | TFP1; TF | ACACATGTGCGTGTGGCCTTCTTGCCCCT GTTTGCCTGGAGGGGTAATATTATAAAT ATTCCTTCTATGGTCTTCTCTCTCCCCTG CAACCCTAGGAAGGTTTTCCTG | 0.018126 | 0.010721006 | 8.87E-06 |
| 1052 | 2643765 | 1 | | GGGCCAACCACTCTCCACATGGCAGCC AGGAAGAACATGGGTGTTTATCAGACTG TGTCACTTACAATCAAGTCCAGACTCCA CACCACA | 0.000108061 | 0.008880817 | 1.02E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 510 | 2644440 | 9 | CLDN18 | ACAAGAAGATATACGATGGAGGTGCCCGCAC | 0.003266926 | 0.017008691 | 1.45E-05 |
| 1523 | 2647113 | 4 | CPA3 | TATTTTACTGTCAATGCCCATGGGACTACAAAAGACTATTGAACATAAGGGGAAAGCAGGAGCTATCTGGATAATTCAGCCAATGGCCAATACTTCACCTGTTCTG | 6.21E-05 | 0.008005576 | 4.00E-06 |
| 1771 | 2647816 | 6 | | CCTCAGTGTATAAGATGTGCAAGACAAATATGCTTATTTCCTTTTCTAGAATATAAGTGATATTATTTGCTTATGACACTAACACTATTAATGACAGGAGTCAATCAGCCTTTACAGCTATCAAAATATAATGAGATCCCAATGATGATTCTTTTTTACTTTGAATGTTAATTAGTTTGGGACTTTGATTGGCTGGCAAACATTTTATCATTGTCAGAATTTAATTTAGATTTCAAAAATAGCTTACAGGATTTTAAACATGGTGTGGTATTCTAAAGCCTTTTTTTTAAAAAAAGAGATCTTTTTGAGAGAAACAAATGAGGATTGTAAAGTTTGGGGACTTACCTCTGTAGCATTG | 1.85E-05 | 0.010052151 | 7.45E-06 |
| 952 | 2647934 | 9 | MED12L | TGCTGCTCTTCTGCGAGTTCATCCGCCATGATGTCTTCTCCCATGACGCATACATGTGTACCCTCATATCTCGAGGAGATTTGTCAGTCACTGCCTCAACTCGGCCGCGGTCACCAGTAGGGGAAAATGC | 0.004800285 | 0.007000581 | 2.37E-06 |
| 1723 | 2648885 | 9 | GMPS | GAGACCTTAAGGATGGCCACCACCACTATGAAGGAGCTGTTGTCATTCTGGATGCTGGTGCTCAGTACGGGAAAGTCATAGACCGAAGAGTGAGGGAACTGTTCGTGCAGTCTGAAATTTTCC | 0.000172838 | 0.007554839 | 3.61E-06 |
| 1035 | 2649525 | 1 | | AGCACTGCGAATGGGGCAAGAATTTTGGCCTTTCTCGCCGGACCTGGCTGCCTCCGCGGGCCTCTCCGCCTACCGCGCTCCCGCCGCGGCCCGACTCCCGCGGGTCTCCGCGCCGAACCCACCTGGCTCCTATCGCACGGGACATTCCCGACCCACCCACGCCGCGTCACTGAGCCTCTGTACCGATA | 8.59E-05 | 0.007182612 | 3.53E-06 |
| 934 | 2649935 | 2 | IQCJ-SCHIP1; AC063955.1 | GCCCGCCGGTGGATGCTCCGCGCCTGCCCTCCGCAGCCTCGCTCAGCAGTCCTGCGTTGGGGTCTGCGCCCTAGGATGCACTGAG | 6.02E-05 | 0.010720906 | 8.75E-06 |
| 1421 | 2650228 | 9 | SMC4 | AGATATAATTGGTTGTGGACGGCTAAATGAACCTATTAAAGTCTTGTGTCGGAGAGTT | 3.17E-06 | 0.016266742 | 1.10E-05 |
| 2003 | 2650244 | 9 | SMC4 | GGGGACTTAGGAGCCATTGATGAAAAATACGACGTGGCTATATCATCCTGTTGTCATGCACTGGACTACATTGTTGTTGATTCTATTGATATAGCCCAAGAATGTG | 1.68E-05 | 0.00695319 | 2.52E-06 |
| 907 | 2651198 | 3 | RP11-298O21.6; RP11-298O21.2 | TGTGATGTCTTTCCCCATCCGTCATAAGGGTCATGG | 5.24E-07 | 0.013460027 | 1.71E-05 |
| 1508 | 2651858 | 4 | GPR160 | AATTTCCTGAAACTGGGCTAATTCTTTGTAGAAATGTGAACGCTGAATTTATTAAAAATAATAATAAAACACAGGAAACAACTTACATGTACATAGGTCTTGAAGTGAGTGAAGCGGCTGTATTTTTTTGGGGGGGGCATTGCTTTTGTTTTTGTAGAAGAGATTGAGATGATACTCTATTCTAATCAAAATTAGAGATTTGTAGTGGGACCA | 1.95E-05 | 0.008579857 | 3.86E-06 |
| 1855 | 2652236 | 5 | TNIK | CCTGCAGGCGTTCATATGAGAGATGTGCAATGCCTGTGCTAGGACAGTGGTGGCAGAGACAGAAAACAGAAGAGAGAAATCAGGAACCATTTAGGAAATAGGATCAGCTGGGCTTGGTGATGAAATTCAGGAGATGATGTCATGGGTGACTTCCTAGTTGGTTCTTGGAGTTGTGATAATGCCCTTC | 9.17E-05 | 0.007559912 | 2.17E-06 |
| 1823 | 2652297 | 1 | | TCTTGGCATCGCCACACCCAGGACTTGCTCGTGCCGCAATTCCCCACGGAAACAA | 3.08E-05 | 0.006668549 | 3.20E-06 |
| 526 | 2653422 | 8 | TBL1XR1 | AATTAAATTATCAACTGTGGTCATCTGCAATGAAGTGACTAA | 0.003210012 | 0.010540491 | 6.82E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 445 | 2655291 | 5 | ABCC5 | GTCGAGTTATACAGGACTAGCCATCTAA CAGGTCATCTGGTCTCCGACGGTTGTTTA ACGACACACAGTAGAAATAGAGAATAG AACCCATATCTGTTTCCAGAGTCCAAAG TAGTATATCAGGCTGACAGCACTCAATC AGTGAGGGCTCCTGAGGTTGCAATGATT CTGCAACGGAGTAGATTCTCTAGGAAAA AAGACCTTGCTGCTAAGGAAAGAGAATT AAAAACAAAACAAAACGAAAAGCTCCC CAAAGAGGTACTCTGCTCAAAATGGCTG GTGCTACTGGTGCACTAAGTTGTGAGGA ATTACCTCTGCTCGGGACAGA | 6.39E-06 | 0.015888528 | 1.09E-05 |
| 1939 | 2658515 | 1 | | TTCCACTGGACTCAACATCCTTTTGCCCG TATC | 3.13E-05 | 0.007764126 | 4.87E-06 |
| 1213 | 2658524 | 1 | | AATATTGCAGGGTTGAGCAGGTGCAATG TTGTAATAGAGGTAGCAGGCCTGAGCGT GTGCAATGTTGTAATAGAGGTAGCAGGG CTGAGCGTGTGCAATGTTGTAATA | 0.002147887 | 0.007985716 | 5.27E-06 |
| 93 | 2658918 | 5 | C3orf21 | GGAAGGGACTCGGAGAAAGCTACAAGC TGGGGCCCT | 0.000102061 | 0.020156465 | 1.03E-05 |
| 616 | 2660844 | 4 | SUMF1 | TTCCAGGTTGGGTGTAGAATCAAACCAG CGACTATCAATAACTTTCAATTTGTTGGA GTTCAGGTGGAGCCTTAATAGATTTTTTA AGCCTGCAAAAGCATGAGCAGAAATAGT GCTAATTTGGTTGTGGTTGATGTAGAGTT CTTGAAGGTTGCTGAGGTCTTGTAGACA GTAATCAGTCATCTCGGTAATCTGATTTT CCTCCAAATGCAGCGTTGTGAGCTGGGT TAGGTTTGCCAGCCCGACCTCCTTAATGT TAGTAAAGTTGTTTTGGGAGAAATCTAG TTCAGTCAAGTTGAAAAGCTGCTGCAGC TCATCCACAGTCTTTGCGATGTTATTGCT CTGTAAGAGAAGCACTTGTGTGTCACTA GAGAGGTTACTGGGAATCCTTGTTAAGC GGAGGTCATTGCAATCAACAGTGGTGGC TTC | 0.002052564 | 0.013982945 | 1.22E-05 |
| 1801 | 2660916 | 4 | SUMF1 | GCTCTGTGAGGCTGAGTAAACACTATTC TCTAACATAGGGACGACATGGGCAACTG AAAGGATTCAATGTAAGTAATCTCTGTG AAGCTCCTAGCAGAGGGTTAGATGCACA AC | 0.006537209 | 0.006595054 | 4.89E-06 |
| 296 | 2661905 | 4 | AC087859.1 | TGGTTTTTAAGTACTGTGGACAGAATGA CCTCTCTTTCTGTCCCAGGGGCCACTCTA GACCAAAACCCATCCACAGCGAAGTTGG TGC | 7.38E-05 | 0.010850848 | 7.91E-06 |
| 757 | 2662405 | 3 | RPUSD3 | CCAGAGGTGTATGTGACCAGGCCCAGCT AGAGGAGGCAGCTTCAGGCTAGCACCCC AACAGGAAAGAACAGTCCTTAGGCCCGG TGGCTTCAGCAATTAAATCAGGGTTGCA TCTCATCATGAGTGGATCCCACAGCCAG GCAGATTGATAGCTGTGATCGTCCTGAC GTGTTATGTGTCCCTCTCTGGATGCAGGG GCCATAGTACTGACCTCACTGA | 0.011000613 | 0.009676955 | 5.52E-06 |
| 1357 | 2663942 | 3 | GRIP2 | CTACCCCGCAAGTCGGGCAGCCTCAGTG AGACCAGTGATGCTGATGAGGACCCAGC AGATGCCCTGAAAGGAGGCCTGCCAGCA GCCCGCTTCTCGCCGGCTGTGCCCAGTGT GGACAGTGCTGTGGAGTCTTGGGACAGC TCGGCCAC | 0.003473534 | 0.00850067 | 5.57E-06 |
| 1027 | 2664336 | 2 | COLQ | TGACCACCGAAACGTGCAGGCATTCTCA CTCACACTGGGCAGCCCGCTGTCGGGTC TCTCTAGGCCTATGAACCACAAAGCAGG GAAGTGGGCACGTTCTCTCGGGGTGGCT CACAGCTTTGAACCTGCCAAAGGACCCC TCGACTGGCCACAGCCCAGCCCAGCCTG ACGTGGATGTGGCTGCCCAGGAAAAGAC TTAACTGTGAAAAAGTACTGAGAACCCA CCTGACCCAGGCTTGCCCCAAGCAGAGG CTAGAGAAGAGGCTCCTCTTCTCAGTGT TTCC | 0.000769819 | 0.007370036 | 1.10E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 963 | 2666262 | 3 | THRB; AC112217.2 | ACTAAGTAAGACCTCTCAGGATCTCAAA GCCAAGTGTTTTACAGAGAAGAGAAGAT AGAAAAGGCATATTATCTAGGAGTGGAA AAGAATTTTATGCTGAAAATGTTGAAGA GAGAATTCAAATCAAATTCAACATTCC ACCTAGGAGGCTTCCATCTCTGCTTAGG AGCTGAGTAATGGAGGTGATTGGTGTAA GTGTTCAGTACCTATGAAGACCTAACTC TTGAGGGAGAGACTCCA | 2.79E-05 | 0.009236679 | 6.52E-06 |
| 696 | 2666522 | 9 | TOP2B | TCAAGATGGTTCTCACATAAAAGGCCTG CTTATTAATTTCATCCATCACAATTGCCC ATCACTTTTGAAGCATGGTTTTCTTGAAG A | 2.38E-06 | 0.013163028 | 1.15E-05 |
| 1149 | 2666743 | 1 | | CTCCATGGGATGGTATCCGAGTGGCTTG GAAAATAATATTTAGTTGTGTTCACCCA CCT | 0.005051331 | 0.008825818 | 3.83E-06 |
| 883 | 2667008 | 1 | | TTCCTTTACATGCTCCCTCGGGTGAAGCA AGGCAGATGGAGAAGGCTTTAGCAGAC AGCGTGGGCATGTTTCCAAGCCCTCAGG CTGCTGAGCAACAATGCCGATGCCAGCA | 6.41E-05 | 0.007673324 | 2.51E-06 |
| 1552 | 2670412 | 1 | | TTGGCTCCCCAGTACCTAGGCATGTTGG ATTCAGA | 0.004140901 | 0.008171632 | 8.16E-06 |
| 2022 | 2673028 | 9 | MAP4 | CACAGGAACGGGGAAAAAGTGCAGCTT GCCGGCCGAGGAGGATTCTGTGTTAGAA AAACTAGGGGAAAGGAAACCATGCAAC AGTCAACCTTCTGAGCT | 2.38E-06 | 0.007570706 | 7.03E-06 |
| 113 | 2673623 | 9 | CELSR3 | AGTTCCACTACCGACCGCGGGGCAGTGA CTCTTGCCTCCCATGTGACTGCTACCCTG TGGGCTCCACCTCGCGCTCATGTGCACC CCACAGCGGGCAGTGCCCCTGTCGCCCA GGAGCCCTTGGCCGCCAGTGCAACAGCT GTGACAG | 0.003413307 | 0.016791865 | 2.15E-05 |
| 704 | 2674247 | 2 | RHOA | CACAGCCCTTATGCGGTTAATTTTGAAGT GCTGTTTATTAATCTTAGTGTATGATTAC TGGCCTTTTTCATTTATCTATAATTTACC TAAGATTACAAATCAGAAGTCATCTTGC TACCAGTATTTAGAAGCCAACTATGATT ATTAACGATGTCCAACCCGTCTGGCCCA CCAGGGTCCTTTTGACACTGCTCTAACA GCCCTCCTCTGCACTCCCACCTGACACAC CAGGCGCTAATTCAAGGAATTT | 3.07E-06 | 0.018909578 | 2.10E-05 |
| 1602 | 2676932 | 2 | RP11-884K10.5 | TCTAAGAAGCAGACAACCGGACATGCGC ATTCATAGCAGAAGGAAACCATCAAGAA GTGGAAGGCTGACCATGATGAGCAGTAG ATGAATGTGTATGTCTAAACAAGGACTG CTCTGTGTCCTCACAGATGAATGAGGTC ATGCTGGGAATTCCCTCTGCAGGGAACT GGCCTGACTGACATGCAGTTCCATAAAT GCAGATGTTTGTCTCATTACCTTTT | 0.003181899 | 0.006579698 | 2.72E-06 |
| 512 | 2676993 | 5 | CACNA2D3 | GAACCAACCACACTGTACCAAAATGAGC TGTTCCCTAGGTCTTGTCCC | 0.013302264 | 0.012413878 | 1.18E-05 |
| 1547 | 2677357 | 2 | WNT5A | TATACCCGATTTAGCAGTGTCAGCGTATT TTTTCTTCTCATCCTGGAGCGTATTCAAG ATCTTCCCAATACAAGAAAATTAATAAA AAATTTATATATAGGCAGCAGCAAAAGA GCCATGTTCAAAATAGTCATTATGGGCT CAAATAGAAAGAAGCTTTTAAGTTTTA ATCCAGTTTATCTGTTGAGTTCTGTGAGC TACTGACCTCCTGAGACTGGCACTGTGT AAGTTTTAGTTGCCTACCCTAGCTCTTTT CTCGTACAATTTTGCCAATACCAAGTTTC AATTTGTTTTTACAAAACATTATTCAAGC CACTAGAATTATCAAATATGACGCTATA GCAGAGTAAATACTCTGAATAAGAGACC GGTACTAGCTAACTCCAAGA | 0.000483071 | 0.008107545 | 3.23E-06 |
| 774 | 2678668 | 1 | | AGGACGGGACTCCAGGTCCACATTACAC CAGACACCAGGACGAGCACCGACCCAG CCCCTGTGGTGCCCTGGAGCACTGAGAT CTTGTGCCAGCTCTAA | 0.000183201 | 0.013190267 | 1.35E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1371 | 2678742 | 2 | FHIT | TACCTAGACCTAAACGGCTCAGACAGGC AGATTTGAGGTTTCCCCCTGTCTCCTTAT TCGGCAGCCTTATGATTAAACTTC | 5.15E-05 | 0.008580237 | 6.43E-06 |
| 1189 | 2678879 | 4 | FHIT | TTTAGACATGAAGTATGAGGCCGGCATC | 0.034438352 | 0.007911619 | 3.61E-06 |
| 829 | 2679967 | 9 | PRICKLE2 | ATCAGCAAACTCATGTTTGACTTTCAGA GGAACTCGACCTCAGATGATGACTCAGG CTGTGCTTTGGAAGAGTATGCCTGGGTC CCGCCGGGTCTGAAGCCTGAACA | 0.000250234 | 0.010916403 | 6.29E-06 |
| 1847 | 2680050 | 2 | ADAMTS9 | CATGAGCCTAACACCCTGCCGGTTTTCAT GCCCGCTGCAG | 6.62E-06 | 0.008282353 | 5.23E-06 |
| 1085 | 2680626 | 4 | LRIG1 | GGGAGCCCGGCTGTGGTACAGAAATAGTG TCCTCCCA | 0.001040005 | 0.00879174 | 3.90E-06 |
| 264 | 2682971 | 9 | CNTN3 | AAGACGCACACAGCCACTGTAGTTGAGT TAAACCCATGGGTGGAATATGAATTTCG GGTTGTAGCCAGTAACA | 0.015576799 | 0.011505616 | 5.10E-06 |
| 770 | 2685234 | 3 | RP11-91A15.1 | CTCCACTGGGCAGGGGTTTCTTCTATTTT AGGGGCCATTAACTTTATTACCACAGTC ATTAACATAAAACCCCCAGCCATATCAA ACACCACTTTTCATCTGATCAGTC | 0.008044591 | 0.00862745 | 5.44E-06 |
| 470 | 2686545 | 9 | ABI3BP | TCTCAGCAAAAGGACCCCGGAAACATTG CAAACTATTCTAATACCTCAGTTTGAATT GCCACTGAGCACTCTAG | 0.000628393 | 0.011468681 | 7.23E-06 |
| 751 | 2687361 | 1 | | TGAAACATATTGTACGCACCAGGAACTA CTTGCTGG | 0.002066608 | 0.007528671 | 2.37E-06 |
| 2023 | 2688904 | 4 | C3orf17 | CCTGTGACTGGGAATTGCAGTAATAAAA AATTGTTGGTAGTAGTCATATTGCAACA GGCCGTTTAAAATGATGCTAATCCTGGG CTGGCTGTATCACTTGATTCTTTCTGTCA CTCGGTTTCTAATTTTTAATGGCAATGAT AAATGCAATTTTTGACCTTCTTATGTGCT AGACTATTTTCTTCCATCTCAAACACCAC TGCTTTTTTGAGCATATTTAGTTGATGTA TGCTGGTAATACTTGGAAACTAAAGAGA CATCTCTTTCATGTCTCTCAGTACATATT GTGAAACTGATCTGATGGATAATTAGAA TTTGCCCGTATCTGTAAGAAGGCCTGTTT TGGGCCATTTCAAACAATTAAGATTATT AGTTCTAATATGAATGTAAGAAAACATT GGATGGAGAAAAGAAAAAAGTTTCTGT GTTTAGAGATTGAAAACCTTGCTTTGAT ATCTTAACCTGGATATCTCAAATAGTATT TCCTATTGTTTTATTTTTATTCTACTTAT TCTTAATCAGAGGTAACAATGTTTGATT ACTAATCATATTATTTTAAAATGCTAAAC CTTTGATACTCTCTTCTGTAATGAAAATA GCTTTAATTTTTGCTGATTATAATACATG CCTGTTTTAAGAAATTTAAAAAGAGAAA TGTGAAGAACCTGAAATTTGCCTAAAAT CTCACCATCTACCACACTTAAAACTTTGA TATGCATCCTTTTGTACATTTCTCCATGT AGTACTTTTTGAATATATATATCTTTC CTGGTAGACTGTCTTACA | 0.000438052 | 0.00735558 | 2.33E-06 |
| 975 | 2689033 | 5 | BOC | GCTGCAGTTGGTCTGTCAAACAGTCCCT GCCTTCTGCTGGAAGCCCCCAGCCCCAA CCCCTGCCAGCTCTCCCCAACTTGGGAA GCTCAGTGGCCTCGGTGCAAGGCTGGCA CATGCAGAGAAAACAAACACATGGAGC CTTGCCAGCTGGATCAGGCACCACTGTT TACAGCAGGAGCAAAGTGTGGGGAATTG GAGAGGCATGAAGAAGGGAAGGAGCAG AGGGGGTGGGATAATTCTAGCCTCCTG CTCTTAGGCTCCACCAGTTGCAAAGAG | 0.000143818 | 0.008308479 | 5.46E-06 |
| 1755 | 2689214 | 6 | | GTAGGCTCCCTATCATTATATATAGAGTT TCTTTTTCCACGGTAGTCAGTGACTTAAC CTGAATTGTAAATGTTTGTAAAGGGTTA ATTGTCCTACATCAAACTTAGTTAAATA ATTCCATCCACTTATGGAGGAGGAGGAG AATGTGGAAGAGGTAAAAAGCTGGGCA CAAGTTCATATGCCTATGAGTCAGTAAA GACTGAAGTAATGTCCTATGTTGAGCTG | 1.57E-05 | 0.007486134 | 3.62E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GTTATTTTGATATATGATAATAATTATCT TTGAAGTAGAACAATTCTGTTAACTGGA AAATCACAGGATATATCCATCATATTTTT CAGGACAGATAGTTTTTACTGTGGGGCA AA | | | |
| 106 | 2689313 | 9 | KIAA1407 | AAGGCAGAAGTGACTCCCGAAATTCTCT TTCTGGACTCAGAAGGAAACCAAAGCAA TTGATGACACCGCATCCCATACTAAA | 0.015311147 | 0.019661807 | 1.60E-05 |
| 382 | 2691686 | 9 | HCLS1 | TGGAGAAGGATAAATGGGACAAAGCAG CTCTGGGATATGACTACAAGGGAGAGAC GGAGAAACACGAGTCCCA | 0.039015171 | 0.014788972 | 1.95E-05 |
| 1669 | 2692363 | 4 | ADCY5 | GGAGGAAGCAACACCAGCCGCTTTGGGG AGGAGCTCCTAGCCTACCAAGAGAGATG GAAAGCATAGACTGGGACCCGAATGTCA CCACCATCATCTCATCTTCACCACCATCT GGCAGCTTCCATGCCTCCTAAGCCAGTG CGTCCCAGGCACTGGGCAGGCTCTGCC CACCTTATCACCAGTCCTCCTGACAGCA CTGCAAGCCAGCTACCTTTATCAACACA CCCGGTTGATAGATGGCTCATG | 0.00180613 | 0.0065665 | 2.64E-06 |
| 1037 | 2693582 | 4 | ZXDC | GAGAATTTTGCCCAGCAGTCCCTCGTGG CTCCCTCCACACCACTGACCCTTACGCAT CCAAGGTTGGAGC | 0.047746878 | 0.008220293 | 6.80E-06 |
| 1354 | 2694294 | 1 | | GCGGGCCATCTGCATGACAAAGGCGCGC CCCGG | 0.000674778 | 0.00923119 | 7.11E-06 |
| 996 | 2696131 | 9 | SLCO2A1 | ATTCTATCTTCCACCCGGTCTGTGGAGAC AATGGAATCGAGTACCTCTCCCCTTGCC ATGCCGGCTGCAGCAACATCAACATGAG CTCTGCAACCTCCAAGCA | 0.003217076 | 0.010887966 | 6.31E-06 |
| 1099 | 2698045 | 5 | CLSTN2 | TAGAGCTAGTCGTCCTTGTAAATTCAGA GTTGAAAAATGTAATTCAGGCATTAAAT GCTGGGGAGCCATAGTAGAGAAGACAG ATAATCACCAGCTCCAAAGCACAGTGCC TGGGCGGGCATATTGTGTGTGCTGAGCA TCCCACCGTGCAAGGCAGTGTTTAAAGC TGTGAACACACAGATGCAGGGACTGTGG TCTCCCTTTTCATGGTGTTCTCACCCTTC ATGGCATCCTTGGTCAAGGTAGGGAGGC CAGAGAGAGCTATAAAGATATA | 6.11E-05 | 0.007604148 | 1.93E-06 |
| 372 | 2698593 | 9 | TFDP2 | AGCAGAGAATAAACCCTCACCAGGCACT GAATCTGCCGGCACTTTCATTTTGGACCT CTCAGCAACCTC | 2.19E-05 | 0.010880081 | 5.99E-06 |
| 1117 | 2699041 | 2 | PCOLCE2 | AGCTCCTCAGGGGAAACTAAGCGTCGAG TCAGACGGCACCATAATCGCCTTTAAAA GTGCCTCCGCCCTGCCGGCCGCGTATCC CCCGGCTACCTGGGCCGCCCCGCGGCGG TGCGCGCGTGAGAGGGAGCGCGCGGGC AGCCGAGCGCCGGTGTGAGCCAGCGCTG CTGCCAGTGTGAGCGGCGGTGTGAGCGC GGTGGGTGCGGAGGGGCGTGTGTGCCGG CGCGCGCGCCGTGGGGTGCAAACCCCGA GCGTCTACGCTG | 0.008011904 | 0.009640861 | 1.01E-05 |
| 581 | 2699705 | 9 | PLSCR2 | TGTCTACCCTAAGCACCAGGCTGGACAC ACTGGGAAACAGGCTGACCACCTGGGCT CCCAGGCCTTCTACCCAGGACGTCAGCA TGACTACCTAGTCCCACCTGCTGGCACA GCTGGCATTCCTGTTCAAAATC | 4.99E-05 | 0.013537973 | 1.13E-05 |
| 1699 | 2701408 | 1 | | TGGTAGACAAGGTAGACCCCCAACAGAA TGTGGAGCCACCTGCCTCCCTGAAGCAT AGGTCACCAAGCCTAAAAGCAGAGAAG | 8.76E-05 | 0.006644833 | 2.64E-06 |
| 1866 | 2701986 | 6 | | CCATATCGGGAACCAAGTAGTACTGTAA TGGGTTTGGCCAGATATCATCTTTGATGA CCTCTCCTAACTCATCAGCACCTGCATCA GAATGGTCAGTAAACCAGGTAAAGAAG CTCTCTGGTTCCTCATGCTGCCTCTTCCT GCTGGCTTTATTCTGTGTTTGACTTGAAC GTTTCGTCAAATCCTTTTCCAGATTTCCAT TTGATTTCGGTGGACTTCGAAGATGGAT CAC | 0.000461778 | 0.009788617 | 6.40E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 780 | 2703842 | 9 | SLITRK3 | ATCCAAATGCAATGCCACAGGCTGTTTG AGGATGGTGGAGGTGGTGGTGGCGGAA GTGGGGGTGGTGGTCGA | 0.002842819 | 0.00956677 | 5.48E-06 |
| 1928 | 2704213 | 9 | PDCD10 | TGATTGAACGACCAGAGCCAGAATTCCA AGACCTAAACGAAAAGGCACGAGCACTT AAACAAATTCTCAGTAAGATCCCAGATG AGATCAATGACAG | 0.000203565 | 0.008620506 | 6.27E-06 |
| 532 | 2705096 | 5 | CLDN11 | GGAATGCCTATTGGGAAGGTGCTCCAGC CAAAGAATTCAAGGGACCAGAGGTCAA GAAAGAGCAGAGAATCAAAGCTGGGCC CCTTGTGGGGAGGCCGAAGTCAGGCAAA ACAAGTGACA | 0.000256815 | 0.01098403 | 7.29E-06 |
| 809 | 2706654 | 6 | | AATGAGTAAGGTTGATAGTGTGGTAGAG ATAGCTGGGGAGAGGTAGAGGGTGGCA TAAAAATGGGAATGAGAATAAGAGTGA GTATAAAAGTAAAGAGTAGAACTTCATC AGGGTGAAAGAATTGGAGGGTCCCCTGC CAGCAAAGATCATCTATGCACTCTAAGA GGGAGTT | 2.79E-05 | 0.009580406 | 3.21E-06 |
| 547 | 2706734 | 3 | RP11-385J1.2 | GTTTGTCAGACTCTCGGGACCATGCTGTT GAAACCACTAAACCACGCTGCCTCTG | 0.000413384 | 0.014860356 | 8.42E-06 |
| 805 | 2708067 | 2 | KLHL6 | CTATTCTGGTCTCAATGGCTTCGGGAAA CACACATATACACATACACCATGCCCTT GAACTCAAAGCAAACTACGCTCTCAGGG AAATACAAATATCACGTTCTTATAGCTG TAAAGTATAGCTTAGCTATTTATAGAAG ACTATGAGGTACTGTTGTGAGTTATTTGC TTATCCTGTTTTATTCTGAAAAATGAAAG TGCTCAATAGAATTTTTAACGTTGGCAA CACCATAAGGATTTCTTATGTTAAGTCCC AACTTGGGGTTGCAAAATCATTTTTTCCC TTAATACCTGGGTGTTGTATTAGATCTCA TA | 0.009399078 | 0.008372295 | 5.09E-06 |
| 373 | 2708335 | 2 | ABCC5 | GTAGCTACCTCCAGACCGTGGTGTCTGG CCTCCATTTTGTCTGTCATTCAGCTCTG ACTTACAGCTGCAGTCACCTTTGCTATAA GGCACCTGGGTAGAAGGGTGGATGGGCT TCACATCAATTTTTTTCTTCCTTTAGGGT GGGGGATTGGTTTGGCTTTCTTTTGTTGT GGTTTTTTGTTTTATTTTTGTCAAGATTG ATTTTTAGATGCAAGGACTTGAAAAGAC CCAGAAGGATGCCACCAGTTTTTCCTTG AGGCCTAGGATTTTTTATTCTGTCCCGAG CAGAGGTAATTCCTCACAACTTAGTGCA CCAGTAGCACCAGCCATTTTGAGCAGAG TACCTCTTTGGGGAGCTTTTCGTTTTGTT TTGTTTTTAATTCTCTTTCCTTAGCAGCA AGGTCTTTTTTCCTAGAGAATCTACTCCG TTGCAGAATCATTGCAACCTCAGGAGCC CTCACTGATTGAGTGCTGTCAGCCTGAT ATACTACTTTGGACTCTGGAAACAGATA TGGGTTCTATTCTCTATTTCTACTGTGTG TCGTTAAACAACCGTCGGAGACCAGATG ACCTGTTA | 7.23E-06 | 0.021678507 | 2.02E-05 |
| 939 | 2708654 | 1 | | AGTGGTCCTCAAGAATCGCTGGTCCAGC CACTCAC | 0.029020011 | 0.007307342 | 7.26E-06 |
| 624 | 2708847 | 3 | TMEM41A | GCTCTTGGGAGGATACTTAATCTCTCA CCTGTAGAATGGGGCAAGGATGGCATGA CTCAGGGATGTAGTGAGGATTACACAGG ACATGTAGTCAAGCACTTAACACAGTGC TTAGCGGCTCCCCAGCTTCCCACTTCCAA GGCTTCCTTTTACTTTCTCTCTTGGATCC CATGTTTTGTCAGGATGATGTCTACCAAC CAAAATGCATTTAGGAAGTATTGGTTCA CTTTTCCCTTTTTCTTAAACAAGACATC TTCAAATGTCTGCTAGAGCTCTGGTCAA CATGGAACCCCGGTATTAACATACTGCA TAGATGTAATTCCAGCAAAAAGCAAAGA AACAAGACATCTTACATAGCTTGTGTGG TCTTACCAAGGGAAAATTCATGGTTTGT | 0.001685702 | 0.010692634 | 7.69E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GTTCATCTTTTGAAATAGTAAAAATAAC TCGTGAGTTTCATTTCTACTTTCTTGGAG CCCCAGTCATTGCAGAATCTACCACAGC CACAGATCCCATTTCATTCTCTCCTGCCC CCTGAGGCTTTTIATCCTTATCCTCATTTT CAAGGTGAAGAGACTGACGGCAGGTGT AGTTCCCAGCCTTTTCATAATTTTTCATT CACCTCTTTAAATGGCAATTGGGACCTG GGGCAGTGGCTCACGCCTGTAATCCTAG CACTTTGGGAGGCTGAGGTGGGAGGATC ACTTGAGTCCGGGAGTTTGAAACCAGCC TGGGCAACACAGTGAGACCCCATCTCCA CAAAAAATTTTAAAAAGTGGGTGAATGT GGTGGTGTGTGCCTACAGTCCTAGCTGC TTGGGAGGCTGAGGCAGGAGGATCGCTT GAGTCCAGGAGTTCGAGGATGCAGTGAG CTATGATCATGTCACTGTACTCCAGCCTG GGTGACAGAGCGAGATCCTGTTTCTTAA AAATAAATAAATAACGCAATTGGGTTTT AGCTGGAAAAAGCAGTGAAGGAGGAG GGAACCTATGACTCTCAGGCTCCAAGAT GACGTGCCTGGTAGCTGCCA | | | |
| 671 | 2710829 | 1 | | GCACGCTGGAAGATAGATGTTGAACAGT TTGCCAGATTCATTTTGAGAAATCACGG ATTGGGAGATTA | 0.000480661 | 0.012195242 | 9.06E-06 |
| 1884 | 2711363 | 1 | | AGTTCTTCCAGCCATTGCGACTGTGGCCC ACGCATGTGGGGAAGAGGCCATTTTTC ACGCCCATCCCAGTTGAGTCTTTAGATG ATCCCTTCCTG | 6.02E-05 | 0.006846258 | 7.64E-07 |
| 824 | 2711369 | 1 | | GAAGACAGTTATTCAAACGGACCTAAAG CATATGATGCTCTGTGCAACACTGGCCC CGTTCACAATGAATGCACTTACA | 0.00250353 | 0.008479945 | 8.04E-06 |
| 74 | 2712860 | 2 | UBXN7 | CTGTATTGATCCTGCTAGTCCAAGAATG GACATGAAGTGAACCTATCGTGGTGACT GGGATAGGAAGGTGCTTGCTATTTTGC CAGCACAGCATATTAGTTCCTTTGGAGC CCTCCATTGTCTGAGTCTGCAGTGATCTG TAGGAAGGCAGCTGGTCAATAATCATGT AGTACAATGGCTTGGAATTGTAACCACT ATGGTTATTGATTGTCCTGTGTTGTTTCA GGCATACTTAGGTATGTCCCTGGGGAAA AAGAAAACCATTCAGCTGAGAGTTGCTA ACCATGTTCTTTTGGTTAGAAATAATGGT TCATTTTTTGCCCCTGGTTGGAATAGTCT CTAAAAGGCTCTGGTGACTGAATTGAAC ATGAGTCCGCATGCTGTTTTCTTTCAAAA GGTATCAAAACGGAAAGCCTCTCTAAGG GGAAGACCTTTCAACTCCATTCA | 0.00020038 | 0.035827272 | 4.83E-05 |
| 1006 | 2713195 | 2 | DLG1 | AACCGAATCCAAGAGCCGTTAGGCAGCA GAGTGTGTTACCACATTGAAATACACAG TGCTGCTGTTAGACTAAATGTCGTAGGTT GTTAACCACATAGAAACACACTAGTATG AAGAAAACTGTTGTAAAATCTCAAGAGC TTCAGAAACTGCCTTACAAGA | 0.005359393 | 0.008326261 | 5.45E-06 |
| 1146 | 2713748 | 6 | | ATCTTACGGGAGGCTGTCTCCAGACAA CCAGCAGCCTGGGCTCCAGGACGACGCC AAACCCACAGGC | 0.000151311 | 0.012719493 | 1.44E-05 |
| 1806 | 2714218 | 3 | MYL5 | ATCTTCAGCTCCTGCTAGGCGCGGGGA AAGTACCAGGCGCTGGCCTGTAACCTCC TTCCGGCTCTGTCCCCATCAGCGGCTCCC CCAGAAGTGATGGCC | 0.005051331 | 0.007306045 | 2.72E-06 |
| 1527 | 2714265 | 9 | PCGF3 | CTGTGGGACATCAACGCCCACATCACCT GCCGCCTGTGCAGCGGGTACCTCATCGA CGCCACCACGGTGACCGAGTGTCTGCAC A | 0.00055537 | 0.006717865 | 2.23E-06 |
| 810 | 2714497 | 2 | FGFRL1 | CCGTGAAGCCTGCAGTACGTGTGCCGTG AGGCTCATAGTTGATGAGGGACTTTCCC TGCTCCACCGTCACTCCCCCAACTCTGCC CGCCTCTGTCCCCGCCTCAGTCCCCGCCT CCATCCCCGCCTCTGTCCCCTGGCCTTGG | 0.000131632 | 0.009136359 | 6.17E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CGGCTATTTTTGCCACCTGCCTTGGGTGC CCAGGAGTCCCCTACTGCTGTGGGCTGG GGTTGGGGGCACAGCAGCCCCAAGCCTG AGAGGCTGGAGCCCATGGCTAGTGGCTC ATCCCCACTGCATTCTCCCCCTGACACAG AGAAGGGGCCTTGGTATTTATATTTAAG AAATGAAGATAATATTAATAATGATGGA AGGAAGACTGGGTTGCAGGGACTGTGGT CTCTCCTGGGGCCCGGGACCCGCCTGGT CTTTCAGCCAT | | | |
| 1686 | 2715217 | 2 | C4orf48 | GGACCACGCTGCTCCGTGTGAATAAATG CCCAGTGGCA | 5.66E-05 | 0.009995655 | 4.38E-06 |
| 361 | 2715538 | 4 | FAM193A | CTAGAAAAATAGTTGATGGCAGTGGCTT CCCCCCCACCCTTCCCCGCCAACTGGCTG TTGCGCTTCTGAGGC | 0.014622507 | 0.010400399 | 1.38E-05 |
| 1143 | 2715773 | 4 | GRK4 | GCCCTGCATATATTATCTATGACTAACCC CAAAACAGACAGCTT | 1.60E-05 | 0.008298962 | 6.27E-06 |
| 947 | 2717272 | 4 | SORCS2 | TTGTCTGGCTGGAGGTCTTCGTCCATGTT GGCTGGCGGGTGAGGTGGTCTCCAGACC AGTGTAACTCTTTAAGAACAGC | 0.013148205 | 0.007377617 | 5.17E-06 |
| 312 | 2717882 | 9 | GPR78; CPZ | TGTCCAGAGCCTACGCTGACGTCCACCC CATGATGATGGACAGGTCGGAGAATAGG TGTGGAGGCAATTTCCTGAAGAGGGGGA GCATCATCAACGGGGCGGACTGGTACAG CTTCAC | 0.038548018 | 0.010132666 | 9.20E-06 |
| 1025 | 2718833 | 1 | | AGCTTAAGTGGACAGGTTCTGCCCCTGC | 0.038548018 | 0.006597734 | 7.31E-06 |
| 1651 | 2719625 | 9 | BST1 | GACTCGATTACCAATCCTGCCCTACATC AGAAGACTGTGAAAATAATCCTGTGGAT TCCT | 0.000130223 | 0.008372717 | 2.39E-06 |
| 1639 | 2719826 | 1 | | GACCCGTGTCCTTGCAGAGCTCATTTCTG GAGAAGAAAGATCTGGTTGCATAGAGTG CCCTGTGATGAGGGCTGTAATGGAAGGG GCAGAGAGTTCCATGGAAAACTGGAGA GAGGAGGCAGAAACTGCTGCAATATCTG GGCTTGAGCTTCACAG | 0.000909538 | 0.007775232 | 3.00E-06 |
| 94 | 2720275 | 9 | NCAPG | AAGATAGGACATGTCTGAGAGCTTTGGA GAAAATCAAGATTCAGTTAGAAAAAGG AAATAAAGAATTTGGTGACCAAGCTGAA GCAGCACAGGATGCCACCTTGACTACAA CTACT | 2.38E-05 | 0.025732286 | 2.34E-05 |
| 1227 | 2720285 | 9 | NCAPG | TGAGACTACCAAGACGAGCCAAAACCGC AGCACTAGAAAAAGT | 1.10E-05 | 0.010793838 | 5.59E-06 |
| 210 | 2720599 | 4 | SLIT2 | CCCTCCGACAGTTCCAATTGATTGAAAA AAGCCTAATTTAAAGTTCTGTTTGTTCTA TGTCTTAAACCATCAGAATTCTCTTTTGG GACCTGAGGAATGCTCTGGAGGAAAAA GAATCCAAGGATAAAAGTCATTGCAAG CCAACAATTGTTCCTAATCCTCACAAAA TGCTGGAGAAATTAAATTTATTCTTTATT GCTCAAAGTGTTACCTAGGTCACTGGGC GATGGGAAATTGGACTGGAAGTCGAGT AGGCGCAAGCTTTGTTTTGTGTCTAGATG CTTAACCTTAGACACGACAAGGCATCTT AGAGTGTTGTGGGAACTTGGTTCAGAGC ATTAACACCAAGACTTTTATTACCCCGG ATTTATAATAGGCTGTGCTG | 0.000279712 | 0.011956609 | 7.08E-06 |
| 838 | 2720737 | 2 | PACRGL | CGTGAACCGCGGGTACAGGTGTCCTGTC TGCGCTCTCTGCCAAGCCGGCTTGCTTCC TGA | 0.000111639 | 0.008424719 | 2.21E-06 |
| 1040 | 2721165 | 4 | RP11-412P11.1 | TACTCATGGGAAATTGGGTACTGCAGAG CAGAGGAGTGGAATGTAGTATAAAATAT TAGTAAAGAGCAAGCACTTTGAATTCAA ATAGGTCTGATTTGGTTACTGATGTTGCC ACTTCTTACCTGTGTGACCTTGAGCAACT TAACTTACCTCTTGTGTTAGTTATCTATT GTCACATAACAAATTAACGAATTTAGTG GCTTAAAAAAACATACATTTATTATCTC ACAGTTTCTGTGGGTCAAAGAGTTGGGG CATTTTTACTGGTCTTCCGCCTAGTGCCT CAGAAAGCTGCAACTCACGTTTAAATCA | 0.011398396 | 0.009482342 | 5.16E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 592 | 2724294 | 4 | WDR19 | AGCCTGGGTTCTCATGAGAGGCTCAGCTGGGAAACACTCCATTTCCATTACATTATGACGAGACCCAGGTACCTGAATCTTGGATCCAGACCTTAGCCCAGGGAGATGACTGGATTGGTAATGACAAATGG | 4.25E-05 | 0.009963907 | 5.26E-06 |
| 1193 | 2725201 | 4 | LIMCH1 | CCAAGTATGGATAAGGGCCAGTCTACCCATTCATCACCTCCTTAGTTGCCAGTCAATTTCCAGTCAAGTAGCAGTGGGAATGAATTATCTAAAAGCTCTCTGCTAGCATACACGTGAAATA | 0.00081399 | 0.007780391 | 4.53E-06 |
| 2034 | 2725364 | 2 | TMEM33 | CTGCGCTGTGTTGCTAATGGTTAAAGAAGTCTGTATCTAGTGATAAATATACCAGTTTTTTTAAAAGATGCTGTTGTGCCTATATCATGAAGTACATTAATTTCTCATGTAAAAAAAATAGCTCTAAAATTTGTTTCAACCTAATTGGTAACCTGAGTTTATATCTGGCATGAATTCATTATGGTGATACACATATGTGAATTCAGTACATTTTGAGACAGTATTCTACCATTCAGTAATTTTGGTTAATGATTTTAACACTTCTCAGTGTATTTAATTTCAAATTGTTTTTTTAATTGGTTTATGCTGCTTTGTTAGGACAGATGTGTTTTGAATGTACCATTATAAGAAGAATTCTATGTATCTTAAACTATGATCTTCTAAAATTTTATTTCCGTAAGTACTTCTGTGGCCTTGAGTATTTTTAAAAGGCTCAACTGTAAGCCTCTTAGCCAGTTGGATAAATATTTGGGGTCACCTAGCCATTGAAAGCAGAAAGCAGTAGTGACACAGCTTTCCCTTCAAAGAGCCATTGAGAAACATTTCTCAAACAGGAAATCCTTCTTTTACTAATGTGGACATATAGATTATCGTATTATAGTTTGTAGAACTACCTAGTTCAGAATCTTGACTGCCAGTTTTCTTGGTTTCTTAGGCTTGAATTTTCATAGACAATTGCAACAGTTTAGATGCCTTTTGAAAGGAATGTAATGAAGATTCAGCATCTGACTATATGTGTGTCTATCCTGAAATAATAATGGAGAGTATACTGTAGATTACATGTTTACCCATCAAATCTGACTTAAAAGGTTAAATGGAAGGTTTTTATAGGTAAGGTAATTGATTGGGAATGGGGTAGGGGGAGGAGTTGTGGGGGAATAATGTGCATTTCAGTCTCAACGCATAGATAAATTTAGGGGAATTGGATGTATTATTCAACTTTGATTTGGGTTGTAAAATGTGTTAATCCTGTTCATTGAACTCCCATCAACTCTTATAAAATTCATGCTGATCTTCATTACCGTTGC | 0.000760518 | 0.007417092 | 5.94E-06 |
| 1848 | 2728354 | 7 | HOPX | TTCTGGCCCAACAGGCTTCTTTCCAAGTTAATGCAGCTATATTCCAAGGAAGTGTTTTATGAAATCTGAATACTCAAACACCCCTTCTGTATTTTCACTCAACCATCATTGTATTAGATGATACATAAGGAAAGTGACTTAGGGAAGTAAGTTCAGAAGGAAATGTGTTCCCTTCTCCCTCATATTATCTTTTCAACAGAGGCCTGGATTGCTAAATGGATTATGAAAGCAAATTGCTACTGGGAGGTGATGGTCAAAAGCAAACTTA | 2.26E-05 | 0.009545719 | 6.32E-06 |
| 337 | 2728905 | 1 | | TTATTTAAGCCAACTATTCCAGATGTCCACCCACGGGCACAGAGCCGCAGAATCAGATGGTATGACCTGTGTGCCAAAGAAAAAC | 0.03372316 | 0.015384819 | 1.83E-05 |
| 622 | 2731160 | 4 | RP11-692D12.1 | CACTTCTCTTTGGTAGGAGGTTCTCTTCCAGCTCTGTGCCTTAAATTAACCGAACATGGCCATGGTTCCAGAAATTTGCCTGCCCTGATCTGTTCACTATGATGATTATGTACATGATTCCCTGGTTCCAGATCTGCACTCACTCCATA | 0.000158328 | 0.011497866 | 7.81E-06 |
| 1018 | 2731449 | 4 | MTHFD2L | ACAGGCCACGTTAGGAATGCATATTTTATAACTTGAATAATGTGTTAGCCTCTTACC | 0.000391017 | 0.00826973 | 4.23E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TCTTCACTATATTGGTTACCTTTCAAACA TACAAGGGCTGAGTTCTTTCTCCCTTTAG ATCTTAGCGTAAATGTCACTGCTTTGGG GAAGCTTTTCCAGCCCATGCC | | | |
| 594 | 2732857 | 9 | ANXA3 | GATTATCCAGACTTTAGCCCATCAGTGG ATGCTG | 0.000487927 | 0.008250723 | 5.40E-06 |
| 1273 | 2733095 | 4 | RP11-438E5.1 | ACATTTCTTCTCACAGGTCTCTGTCCCTC AATACAAGTAATTAACCCAAATAGATGT CTGCAAACCTCTGCTAACTTTTTAGCAGA CACAGGAACTTCTCAATTTTATTGTAATT ACTACAGACTATGGTAAAAGTAACGGCA AAGTTTACTTACTAGGGTCTGGGGGGCA TACATGGAAAAAGCACTTAATTCAAGCT CAGGGAAGTGAGCATGGGGAGCTGGAA GGATTCCTGAAAGACAATACAACAAAAC TGAGAACCTAAGAAAAAGTGGCAATTAG CTAGGCTACATGGACCCTTA | 0.000314052 | 0.00752303 | 3.35E-06 |
| 426 | 2734127 | 8 | RP11-8L2.1 | CTGCCTTGATGTGCCCACCACAATACCA GGCGGGCAAGATGATAATCATCGAGCCA GCTATTATGAGCAGTATAAACAAATGAC AAATCTCTGGGTGCAGGAAA | 0.002481187 | 0.014163778 | 1.48E-05 |
| 1873 | 2735462 | 4 | HERC3 | CAAACCAGGGCAACCAGACCGAGAGGA GC | 0.004105357 | 0.007182623 | 6.66E-06 |
| 674 | 2736504 | 9 | BMPR1B | TCCTCATCAAAGAAGATCAATTGAATGC TGCACAGAAAGGAACGAATGTAATAAA GACCTACACCCTACACTGCCTCCATTGA AAAACA | 0.000254163 | 0.013616013 | 1.23E-05 |
| 933 | 2736527 | 4 | BMPR1B | AAACACAGTAGAGTCTGCAAATTTCATC AGTCAGACCAAGATAGTTACCGTCCTCG TAGAGGGGTATGCTGGATTTCCAAA | 0.009101689 | 0.006962968 | 2.94E-06 |
| 1950 | 2737930 | 5 | CENPE | AAGGTTTTCCTTGAGCTGGTCTCTCTCTA CTTTGAGAGTCTCCTCCACACTCCTAAGG TCATCTCTTTCTTTTGTTACAGATCTCATT TCTTCAAGGTTTTCATGTAGTATCTGAGT CAACCTTATATTCTCCGTTTCTATGTTTT CCAGGTTTAACTTCTGGGTCTCAAATTGC TCCTTCAAGTGTTCTATTTCACACATTTT CTCCTGAGTCTCATTGACAGCTGTC | 0.000664925 | 0.007944468 | 5.90E-06 |
| 176 | 2737932 | 5 | CENPE | TCTCTCTATCTGAAGGGCCTCCTGTACTC TTTTCATTTCCTCTTTTTCCTTAATCATAA TTTGTATTTCTTCTTGACTTTCTTGAAGTC TGTTGGTCAACTCGAGCATCTTACTTTCT ATACTTTGTAGTGCTGAATCCTTGGCTTT GCGATGCTCCTTG | 2.22E-06 | 0.026656504 | 2.45E-05 |
| 867 | 2737940 | 5 | CENPE | TGGTTATAGATTTCACTTCCTCATAATTT TCATTAAGTTTCTGAGCCAACTCAAGCCT CTCTGTTTCCATATGTTCCAATGTCAATT CTTTGTTCTTTAATTCATTCTTTAAATTCT CTATTTCATTAATCTTTTTCTGCATCTCA CTCATCTCTTCTTGTACATTAAGAAGTTG TTGCTG | 4.53E-05 | 0.015521495 | 1.13E-05 |
| 1447 | 2740920 | 4 | NDST3 | TGTAACATTCCCTCTATCTCAAATGTCTC TTCAAATTACTCCCATCCTTCAAGGCTCT ACCCAAATCCTACTCCACAGTACAGCCT CACCACCCCCTGGAGCATTCCACAGACT CCCCCACTTGCCATGGTCTCTTTCTTCTC TCATCCTGTTATAGTCATTGTCTCTAATC CACAACCCTCACATTATTATCATTCTTGT CACTATCTCTGCTTTATAATTTAGAACAT TTTAAATAAATTCAGTCTGCTGAACATTT ATATTTTAAATAGCATGAGAGCTACCCC ATAAATGTTTGAATGCATGACATATATA CC | 0.001339198 | 0.008462414 | 8.23E-06 |
| 1930 | 2746264 | 1 | | AAGAGGAACTTCCGCCCTGTCCCTGGAC CTCACATTTTCCTGGAAAAGAAAGCTTC TGGCACTGGTGCACACATTAGGCCAAGA GGAGCCTGCTTTCCTTGACTTTTCTG | 0.000292246 | 0.006691996 | 4.00E-06 |
| 280 | 2746800 | 9 | ARHGAP10 | TACAAACCTCCAGGGAACCTGGCTGGCT AGAAGGGACTCTGAACGGCAAGAGGGG GCTGATTCCACAGAACTACGTC | 0.000356857 | 0.010703669 | 8.03E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 161 | 2746996 | 1 | | CACAAAGACAACAGGTGGAACTGGCAT AGCATTTACCCTTGGTCTGAGAGATGGC CTGGGCCACTTTGAGAAAGGAGTAGAGC TAGAAGC | 0.006154763 | 0.011745989 | 6.30E-06 |
| 238 | 2747807 | 1 | | AGCCGCCGCTTCACATCGGGGTCCCCGC CCCCCCGGCCGGGGGGTGGTTGCCGAGC TTGGTTGGGGCCCCGGTTCATACACTCC GGGGCAAGATGCTACGGCCCCGGGCGG GTGGCCGAGTCGGCGGCAAGGCGAGGG ACCCGGCCGGCTCCGCTCGGCGCCGCCC CCGCTCCCGGCTCCCGCATGTGTCGCTGC GGCTGG | 0.004167745 | 0.012491376 | 6.74E-06 |
| 700 | 2750636 | 4 | CPE | GCATGTATATCCATCATCGAAATACAGT ACTCATAAAAGAAACCTTTATTAACTTA TGTCTAAGTAATGGATTCTGTGTTCCCAG ACCACTCGACCCGGAGTTAAAT | 0.013148205 | 0.013210393 | 1.20E-05 |
| 1147 | 2750647 | 4 | CPE | TGAGTACAGCCCACTGATTGACATTCAA GACCCATTGGAAAAATCAGGAGACACA AGAGTGGGAAGAGTGCAGATTGGAGCA GCTATCCAAAAATACA | 0.00059375 | 0.011114732 | 9.38E-06 |
| 1003 | 2751964 | 4 | GALNT7 | TTATTCTGGCACACAACCTGGTTTACATT TTTTGAATTATTATTTCTAAACTATACAT TGGTGAAAGGAGATGGAAACATTATACA ACACACAACACAAAATTATGCTCTATTC CAGCTCTGTTGTCCCCTGTCCTCTGTAAG AACGCAAGGCCTGCAGATGTTCCCCAAA TGGAGGTCCCTAGGACAGCAAAGGTGCC CCTCACCACCTTCTGTCACCTTCACCCCA CCCTTTTCCTCCCTCCTTCAGCCCCTTGA TGTTTCTAATTCCGTCCTGTCTCCCATTC AAAGTTTCTATCTTGCCCTTTTCCCCAAG TTGCTATCTTCTGCCTTAGAAGCAAGTCC CAAATTTCCTTTCATGTTTTACGTATTTT CACCAATTCTGGTGTCCGTTGTAAATC | 0.000111337 | 0.006519285 | 3.50E-06 |
| 1259 | 2751997 | 5 | HMGB2 | CTAGGTCAACTGTGTCTAAGAACTACTA GGCAGAAATACCGAAAAAAATCAACAT AGCTCTGGTCTTCAAATGGCTTTTTTAAA GTGAAAATTAACTTAGCATATTAAGACA AAGACAATAGAAATAATATACATAATTT TATTACAAAATTTTTTTTAAAAAAACGA AATGCAACATCCTAAAAAACCCAAAATT TACTATTGATACTAATTCCTACAAGTTTG CTGTGCTACCATACACAAGAAATTAAAA AAACCATTAAATATTTAGGAACATTCAA CATCAGAAGCTGTAAAATCTAACTGTAT GAGTAGCCCATCAAAAAGCTACAACCTG CATTTTTTAAAAGTATTTTCTCTACAGAG AATCTTATCAGCTATACAAAAATCTGTA CAGTTTTTATACTGAAGCTAGTATTGAGC TGCACTTGAATTCACATTCTTAGCAAAAT AATTGCCTGAGCACACACACACATTCCA CACGCATCATTAAAGGATAGCCATTTAT TCTTCATCTTCATCCTCTTCCTCCTCATCT TCATCTTCTTCTTCCTCCTCCTCCTCCTCA TCTTCTGGTTCGTTCTTCTTCTTTGAGCC | 0.000731459 | 0.014936895 | 1.55E-05 |
| 1860 | 2754413 | 5 | MLF1IP | CCTGGGACCGATTAAGGTGTCAACATTT TAAAATTACTCAAGATATTAACCAGAAA AGATGATTATGGCCTTTAAAACTATTGG ACAAACTGATGCTATTTAACATTGTTCAC AGCCATTTAATTTGAATAACAAATTTTA GATTCTAAGTAGGCCATAACTTCTTTGCA AAACAATTGATTTATAAAGGTACAGTTT CAGAAGGTAACAGCATGAGACTAGTCTT CCTATAGGCACATTTTAGTAGACTGCTCT TCTCATCCCTGGTCAAGGAGCTTCTCTAA CTGATGGTTGATATTTCGCAGATGGCTTT CGGCTCCCAGAAGTGTTCTTGCTTTAAAT AACAGAGCTGGAAGGCTGGATGAATCAT ACTGTTGAAAGAAAATTATATAATTAGC AATATCAAAAACTCATAACCTTGTCCTT | 0.000257482 | 0.008133228 | 5.30E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AGATAGCCCAATCTTATGACTAATGCAA ATTTTGATTGAGCTTTCCATTAACTACTC CTCCTCTCATTTTTAACTAGGACCATTAA GACAATTGGTTTTAATCCATTTCCCTTAG AATATAATTGATCACAAAGTTGCTAGGG AGCTGCTC | | | |
| 1274 | 2757410 | 1 | | AGGGAACCCTCCATCCAGGTGGTCAGGG | 0.000310049 | 0.008014173 | 7.49E-06 |
| 1130 | 2757591 | 4 | WHSC2 | GGGCCGCCCTGAACATGTTGTAGTGGAG CTTCCGTCTGTCTTCAGCTTCCGTCAACA CTGAACCAGCTCATCTAAGCACCAGACA CAAGATTTTACTGCTTTTGTCAGGTGGAG TGGGAAGTCGCACCCACGTCTGGCCAGT TGGGTCGGCTGTAACTCAGACTTTGGAC TGACTTGTCACCCAGCTCATATAGCAAG GAGTTCCTGATGGCAGCTGGGGGAGCTG ACATCAGTGTCAGCTCAGACTCTTAGGC AGTTA | 0.012547908 | 0.007213149 | 4.68E-06 |
| 88 | 2758470 | 1 | | GCCAGGCACGCAAATATGGGGCCCTTGT GTGGTGTGC | 0.003071703 | 0.024935438 | 2.95E-05 |
| 385 | 2759511 | 5 | SORCS2 | TGGGTTAAATGGTGCTCCACACATGCAA ATTTATGCTCACCTCGAACCTCAGAATGT GACCTTATTTGGGAATAGAGACTTTGCA GATATAATTAGTGAAGACAAGGTCATCC TGGAATAGGCTAGACCCTAAATCCAATG GCTGTGTTCTTATAAGAAGCAGGAAACT TGGACAAACACACACAGAGAAGTCCATA CAAAAAGGCAGCTGCAGAGATGGAGTG GGGTGGCCAAGAAGAAGCCAAGGACTG CCAGTAACCATCAGAGGCTGGAAGAGGC AAGGAAGGAAACTGCCCTGGGCTTGGGG CCTGCCCACACCTTGATGTCAGACTCTG GTCCAGAGCAGTGTGAGAATACGTTTCT GTTACTTTAAGCCATCCAATCTGTGGTCC TTCATTATGGCAGCCATGGGACACAGAT GCAGGTTGTATATTAAAGCAATACCAAC CAAAATGAAACAAAACCAAGTAGAACA TGCAACAGAGACAGCGTATGCCCCTAAA GCTTAAAGTATGTACCATCTAGCCCTTTA CAGAAAACGTTTGCCAACCCCTGTTCTT GAGTAGAATCCAAACTCCCTATCACTAT CCCAGCGTTCACAGCCTACTGTCTCCCCA GCCTCATCCCAGGCCATCCCTCCTCCTTG TAGCCACCACTCTTGCCATGCTCAGTCTC ACTCACTGACCATCCACCTTTTTTTTGCC TCAGGGCCTTTGTGTACGCAGCTGATCA CAGCTCATGCACCACTTCCTCAGGGCAG CCTCTTTCCCATCTCCCCACAGCCTGGGT CGAGCACATTGTGACACTACTTCAGAGA ACCCTGACCTCCCTTTTCCCAACACAATC ATGGGGTAATTAAGTACAATTACTAGCT AGTGATAATGAATTATAATCAATCGAGA AGTTCAATTAACTGGGTGATCATTCACTT ACTGCCTGCCCCCATACTAAGTTGTCAA CTCCATGGGGTAGGGGCTAAGTCACCAG TAACCACCACAGTGCTTTGTACAGATCA AGTACGTCCTCTAGAAATATTTGTGGGA CGGATGGGTAGATGGATAAATGAATACA TGGATTAAGAGGTAGATGGATAGATGGA TGGATAGGTAGATGGATGCATGAGTAGA TTGATGGATAGGTAGATGGATGAATGGA TGAGTAGACTGATGGATGGGTAGATGGA TGGATGGAAGGATGGATGGGCAGATGA ATGGATGTATAGATGGGTAGACAGATGG GCAAATGGACAGATGGACAGATGGATTG AGGGAGAGATGGGTGGATGAGTAGGTG GATGGATGGATAGATGGATGGGTAGATG AATGGATGGTAGATAAATGGATGGGTAG GTGGATGGATAGATGGATGAATGGGTAG ACGGATGGGTAGATGAATGGGTAG ATAGACGGATGGGTAGATAGATGGATAG | 0.000790656 | 0.006915943 | 5.83E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | ATGGATGAATGGATAGATGGATTGGTAG GTAGATGAATAGGTAGATGCATGAATGG ATACATGGATGGATGGGTAGATGGATGG ATAGATGGATGAATGGGTAGATGGATGG ACAGGTAGATGGATGAATGGATAGATGG ATTGGTAGGTGGATGAATAGGTAGATGG ATGAATGGATACATGGATGGATGGGTAG ATGGATGTATGGATGAACAAACATAATT TCAGGAGCTCCCCAGGCTAGTCTGGACT TCCAGCCGCTCCCCTCCATGTCTGTAGTT AGTCCTAGGTTCCTACCTGGCCTGGAGT CCCACCTAGACCTCAGATCCAATAGATA AAAGTGATTCTCTTGTTCCCATGTCTCAG TAGCCCTGTATGACAAATTAAAAACTGA GTGGGTTTGAATAAAGGGCCACGAAGCC CCCATTTGGGCCCAGATCTATACTGAGT AGGACTCTAGACACCCAGGGATG | | | |
| 504 | 2759598 | 2 | AFAP1 | GCCAGCCTGAAGTCACGGTCCTGGCCCA GCA | 0.021792834 | 0.006631939 | 1.53E-06 |
| 1327 | 2762889 | 5 | SLIT2 | TGCTGGCCCAAAGCCAGTCCAGCACTGC CTCCTCTGACTCTAAAATCAGAAGAGTC CTGA | 0.025498894 | 0.007381634 | 3.06E-06 |
| 1676 | 2763219 | 4 | KCNIP4 | GCTCAGGTCTCTTATTGGGAATTTACATG ATGTTCTGGTGTAGGCAGAGGCATTTCA AATTGGTGTAGGAATTTTCAAATTAAAT AGGATGTTTCTCTAATTTTTAAACTTAAT TTTGGGAATCACTTATTTTAGGGATATTA TTATACATCATCTAATATTTCAAGCACTT GTGAAAGTCACATTCTGCTCAACTTTTCT CACATCCTTTCCAAGAATTTTAAATCACT TTTTCCATATCATCTACTTTCATAAACTC CCTTTAATTTGAAGATGAGTCTTTTCTAC TTTGATGCACAGTATTATTGCAGTGGTTA TCTGTTCCCTGTCCGCTCATGGTCCAGTT TCATCAGGATTTTCTGCTGAAGTCATGAT ATCTGAGAGAGTTGGCACATACTCTGAA ACGTAGGTGCACTGTGTTAATTTAAAAG TTGTGGGGAGGAAAATCTTGGGGACAAG TATAAAACAATGAGAGTGCAGAACCAG GCATTGAGAAACATGGAAAAAGGAAGC CAGAACCTGTAAAATACAATATCCAGGG ACATGGAGTGAGGGAATTCTCCTACTGT GGATTTATAGAATAAATCTCATCTTTTAA AATGGAGATGTTGTAAGATAGTTTTTAA GAAAGGGCACACATCTAAACTGGGAAG CTGGAAGGTAATAAATACTAACACTTCT GATGTAATTTAAGTACAGGAGTCTCCGC TACACCCTGTAAG | 9.72E-05 | 0.007286607 | 5.33E-06 |
| 231 | 2763921 | 9 | CCDC149 | GACCCCACTCTTCCTAGTGGACAGAGGT CGAGATCCCCACTGCTGAAGTTTGTCGA GCAGCCCACTGAGAAC | 4.35E-07 | 0.020155155 | 2.18E-05 |
| 275 | 2767308 | 4 | BEND4 | GGTGCAGCAAATCCGTTTTCTCCTTTTAC ATTGGAGCCCTGGGGTTAGATGCAGACG AGTAGTGTTTTCCCACGCCAGGCAGGCA CCGACTGCAAGACAGACACTGGGTAGAA CCCAGAAGAATGTAATGGAACCAGATCA TTCCTGGTTTCCCCAAGTCCGAGACATG GTTGCAGCTAGCA | 0.002052564 | 0.017199346 | 1.77E-05 |
| 475 | 2769840 | 9 | KDR | TGTAAGTACCCTTGTTATCCAAGCGGCA AATGTGTCAGCTTTGTACAAATGTGAAG CGGTCAACAAAGTCGGGAGAGGAGAGA GGGTGATCTCCTTCCACGTGACCA | 0.000199853 | 0.007321611 | 4.45E-06 |
| 489 | 2771025 | 5 | LPHN3 | CTCTTGCAAATTTCACAAGCTTTGGCTGT GCTCCCTGAAAAATCAGCAGCAGCAATG TCCTTCAGGCAGCAGCT | 0.000172838 | 0.01109885 | 9.41E-06 |
| 574 | 2771634 | 4 | RP11-584P21.2 | TTTACTAGGTTGCATAATGACTCCCAAA ATTTACGTCCACTTGGAATGTCAGAATG TGACTTCATTTGCAAATAGGGACTTTGTA GATGTAAAGTAAGCATCAAGATGAGTTT ATGCTGTACTAGGGTCAGCCCTAAATTC | 0.003428273 | 0.009027656 | 3.62E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ACTTCTAAGAGACAGAAGGACACCCAGG AATACATGGAAGGCCATGTGAAAATGGA GGCAGAGCTTGGAGTGATGCCCGCCACA AGTCAAGGGATGCTGGGAGCCACCAAA AACTGGAAGAGGCAAGGAAAGTTTCTCC CCGAGAGCCGTTAGTGGGAGTGTGGCTC TGCTGGCAACTTGATTTCAGACTTCTAGC CTCCAGAACTCTGAGGTAATAAGTTTCT CTTGTTTTAAGACCCCAGGTTTGAAGTA GTTTGTTACAGCAGCCCAAGAAACAATT AATATGTCTGAAAGTGCTACCAGATGAT TTGCATGTCTCTTTAGAGTGATTACCCTG ACAACATA | | | |
| 1248 | 2772766 | 5 | SLC4A4 | TTCTTCCCTCTCCTAACTCCGTCAGACTG GCCCCAAGACTGTGGCTTCAAGGGCCAC CAGTCCCTTACTCTTCAAGCCCTGACTAT GGAGTTGGCAGATGA | 5.40E-05 | 0.009353946 | 6.89E-06 |
| 573 | 2773378 | 1 | | AGCATCTCCCAGAGGGCTGCGTGCCTCA GAAAAGCCGGCATCCCTAGCCCGCTCTG GCACAGGCCATGAG | 0.000425014 | 0.008077849 | 2.20E-06 |
| 817 | 2775033 | 4 | ANTXR2 | GGAATAAGACACATTGTACCCACTAAGT AATTTTTCATCCTCCACTCCCCTCTCTCC CCCATGCTTGTGAACTCTTTTCTATTGTA TATTTTTAGCAGACTATCAGCACAAGTCT TACAGATAGTATTGTGTATACCAATAGC TATTTTGCCTAGACGGATTCCTCCTGGAA GTTCATACCTTTATTTCTGCCTATTCTGT GCCCTCTGAG | 0.002641545 | 0.011265019 | 7.43E-06 |
| 814 | 2775038 | 9 | ANTXR2 | GAAAGCAGGAGGCTTGAAAACCTCCAGT ATCATAATTGCTCTGACAGATGGCAAGT TGGACGGTCTGGTGCCATCATATGCAGA GAAAG | 0.045938047 | 0.010132648 | 2.35E-06 |
| 340 | 2775115 | 1 | | TGTCATAGCAGGATGATAGGTACCCCGC AAACAAGCACAAACAGGGAACGTGATG AGAGTGGAAGTGGTGGCCTGCAGCCCCA AATTGGCTTGGGAGGATCATACCCATGAT GACAGGGAAGCCTGCAGTACTCCAGCAG ACATGAGAGTCACCCAGAGCTTATA | 0.000146929 | 0.015266238 | 9.71E-06 |
| 948 | 2776793 | 3 | MAPK10 | GCTCCTTGCAGCAATATAGCAACTTAGA AATGGCGGG | 0.001522517 | 0.00974321 | 4.48E-06 |
| 1164 | 2776796 | 2 | MAPK10 | CTGCAGTGTGGTGAACTCCAACTTTTAG | 0.003534738 | 0.007120783 | 3.70E-06 |
| 555 | 2778529 | 4 | UNC5C | TGGGGCTACAACTCATGTTCCTTGGCTCC CGGTTCCAGCTGCTTTCTACCACACAGC ACTGCATCTTCAGCTGCCCCCATGCAGA TTTATATTGCATGCCTCTGAGTCTTATGC TTCCTTGGCAAACCAGGCAGTCGCAAGC TCCAGTGCCTACTGGGACCAATGAGGTT ACGTGAGTAAGTGGGCTGAATGTAGTAC AACAGATTCTGCTGGAAAGTGTGGTGAT CTGGAGAGCACATGTCCCGTCTAAAACA AAAGACTCCAGGTTCTCACTGCAGGA | 0.005485054 | 0.009116757 | 6.23E-06 |
| 45 | 2780211 | 9 | CENPE | ACAATTCAAGGAGCATCGCAAAGCCAAG GATTCAGCACTACAAAGTATAGAAAGTA AGATGCTCGAGTTGACCAACAGACTTCA AGAAAGTCAAGAAGAAATACAAATTAT GATTAAGGAAAAAGAGGAAATGAAAAG AGTACAGGAGGCCCTTCAGATAGAGAGA GACC | 7.94E-08 | 0.085631944 | 0.000102736 |
| 821 | 2780715 | 3 | RP11-710F7.2 | CAAACTTGTGGCTTGGTGATCCAGGGGT TGGAAAAGAGGCTGTTCACTGCCTTGGT CAAGAGGAGCTGGGATGTGCTCGTCTTC ACACCAGGAAGAAG | 0.004749446 | 0.009335921 | 7.74E-06 |
| 565 | 2781004 | 2 | PAPSS1 | CAGTCACTCCACCTTTGACACATTACTAG TAACAAGAGGGGACCACATAGTCTCTGT TGGCATTTCTTTGTGGTGTCTGTCTGGAC ATGCTTCCTAAAAACAGACCATTTTCCTT AACTTGCATCAGTTTTGGTCTGCCTTATG AGTTCTGTTTTGAACAAGTGTAACACAC TGATGGTTTTAATGTATCTTTTCCACTTA TTATAGTTATATTCCTACAATACAATTTT | 0.002537394 | 0.011813474 | 8.67E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
|  |  |  |  | AAAATTGTCTTTTTATATTATATTTATGC TTCTGTGTCATGATTTTTTCAAGCTGTTA TATTAGTTGTAACCAGTAGTATTCACATT A |  |  |  |
| 1966 | 2782139 | 1 |  | AGCCTGCTTAGACAAATCCTGCTACCTG TCAGCCCTCCTGTGGGTGCCAAACCGGC TGCCAGGTTAACCTCTGGGGAAACAGGA AGACCTGCTGATTTAACCCCTACTTCCCT TCCTATAATCCACAGTAA | 0.000402054 | 0.006574721 | 2.46E-06 |
| 1129 | 2788582 | 1 |  | CCCGCCCGTGCTCTGTTGCCGCCGCCCCT TCGCAGCGTCCCGCGGCTGCTACTCACA ATCGCGCCCCCACT | 0.014042909 | 0.007952057 | 7.05E-06 |
| 1902 | 2790298 | 5 | KIAA0922 | TGAATGGTTATGCAAAATGTGGCATATC CTACAATGTGTATTATTTGCAATAAAAA GGAATGAAATACATGGATGAAACTGAA AACATGCTAAGGGAAAGATGCCAATCAC AAAAGACCATACATTTCATTTATATAAG ATGTTCAAAATAGACAAATCTTTAGAGA CAGAAAGTAAGAGACTGAGGCAATGAA AATGTTCTAAAATTAGACAGTGATCGTG AGGGCTGCACAA | 2.67E-05 | 0.008591867 | 4.35E-06 |
| 1604 | 2792487 | 5 | CPE | CTCTGAGGGTTGAGAAACATTTCCCAAC TATCCTGTACAATTCTCTACATGTGAATT ATCATGTAATCCCTTTGAACTACATATCA TGCACAGAATTTATGATTTCAAGTTCTAT CCTGTGCTATTTAATTTCTAAGCTGAACA CATATTTAACAGAAGGCAAGAAAGAAG ATGAAATGTGGTTCACACATTTTTCATCA TAATCCATTTATATAAGATAACTTGGAA AAGAATCTGTAAGTCATTTTTATTAGTCT GTCAAAGAAATGGCTGCTAATAAAACTG CCGAATCAAATCATTACCAGTACTGTGC ATTGACCCTTGGCATA | 0.00241526 | 0.007846726 | 2.23E-06 |
| 840 | 2793953 | 2 | HMGB2 | GTGCAGCTCAATACTAGCTTCAGTATAA AAACTGTACAGATTTTTGTATAGCTGAT AAGATTCTCTGTAGAGAAAATACTTTTA AAAATGCAGGTTGTAGCTTTTTGATGG GCTACTCATACAGTTAGATTTTACAGCTT CTGATGTTGAATGTTCCTAAATATTTAAT GGTTTTTTTAATTTCTTGTGTATGGTAGC ACAGCAAACTTGTA | 1.54E-05 | 0.017289428 | 1.47E-05 |
| 730 | 2794726 | 4 | ASB5 | CTTGGTTATGTTGGATCTGTTTCCCTTTTT TGTGTTGTTCCAAGTGAGATTGGAAGAA AAGATAATGTAAGAGTTGGATGGCA | 0.024147101 | 0.007418717 | 7.68E-06 |
| 861 | 2795876 | 1 |  | GCCCTGCTGTAATTGTGAATGGACACAT GCAACAAGCCCAGCCTTAGGAGAGTGTG ATCATCAAGGGCTCACACCTCTCAGGAA TGAAGAGTTGGTTCACACCACC | 0.029646817 | 0.009793545 | 8.29E-06 |
| 1119 | 2796405 | 4 | IRF2 | AGAGGAAGCGAGACCACAGGAACTAAT GGGGGGCCCAGGTGGAGAGGCGAAGTCC GGAAAGGCAGACAGCGGGTCGGAAGTT TGGTT | 0.003781407 | 0.008632721 | 4.33E-06 |
| 1330 | 2798289 | 1 |  | CTTTGCCGCCGGCTTGGGCACGTTTCCTC AGCGTCTCTGGCTCCCCGTATTCTTGTCT TCAACACAATGGGTGGAAGTGTGGTTCA GTGTCTAAGAAAGTCTCCAGCACAGTGT G | 0.001108971 | 0.00695949 | 1.53E-06 |
| 1703 | 2798596 | 4 | PDCD6 | CAGTGGGCATTGCTGTCGGTGCTCCCTTT CCGGG | 0.003906364 | 0.006523124 | 7.17E-06 |
| 801 | 2799905 | 1 |  | ATGCTATTAAATCCGGTCAACGGTGTGT GTGGAGCCTGCTCCATGGCCAGCACCCT ATTGGGTCATCACCCCGACCATGGAGGA CAGAGGGTGCCATCCCTAGAGATGC | 0.026532368 | 0.007637195 | 7.17E-06 |
| 1047 | 2800042 | 9 | ADAMTS16 | CCAGGACTGGTGATAAGTCACCACGCAG ACCACACCTTAAGTAGCTTCTGCCAGTG GCAGTCTGGATTGATGGGAAAGATGGG ACTCGTCATGACCACGCCATCTTACTGA CTGGTCTGGATATATGTTCCTGGAAGAA TGAGCCC | 0.049865614 | 0.007127301 | 7.62E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 909 | 2801585 | 1 | | GAAGCCAAGCATATTCGAACTCCGAATC CGCTCGATCGCCGGGGACCTGCCATCTG GGTTCGGTTCCCCAAGGTCGCTGCCGAC CTTAGACCGCG | 0.001054975 | 0.009377942 | 6.51E-06 |
| 1356 | 2803060 | 4 | FBXL7 | AGGTTTCATTGGACATATACTTCCATGTG GCTGGGGAGATCTCAGAATCATGACAGG GAGGTGAAAGGCACTTCTTACATGGTGG TGGCAAGAGAAAATGAAGAAGATGCAA AAGCGGAAACCCCTGATAAAACCATCAG ATCTTGTGAGACTTATTCACTATCACAAG AACAGTATCATGGGGAAACCGACCCCAT GATTCAAATTATTTCCCACCTGGTCCCTC CCACAACACGTAGGAATTATGGGAGCTA CAATTCAAGATGAGATTTGGGTGGGGAC ACAGAGCTAAACCAGGGGAAAAGCACA TTCTGGGGCCTATCAGA | 0.001602179 | 0.007148233 | 4.28E-06 |
| 1721 | 2803194 | 7 | FAM134B | TTCAGGTATATTCCTCCAAAACCCACAC AGTTCAGAGATTTTCAAACACCAGGTTT CCATTTGTATTAAAATGGGCAAGATAAT GAAGGCACAGGCTC | 0.000412342 | 0.009777832 | 1.19E-05 |
| 1961 | 2806221 | 4 | TTC23L | TGTTGTACAGGGCAGCATGTCCTGAAAG GGGCTGCAAGAAATGCTGATTCCAAGGG ATGTGTGCCAGTTCTCT | 0.003181899 | 0.007438554 | 4.93E-06 |
| 1031 | 2807753 | 9 | C7 | GCAAATGTGTCTGCCGAGAAGCATCGGA GTGCGAGGAAGAAGGGTTTAGCATTTGT GTGGAAGTGAACGGCAAGGAGCAGACG ATGTCTGAGTGTGAGGCGGGCGCTCTGA GATGCAGAGGGCAGAGCATCTCTGTCAC CAGCATAAGGCCTTGTGCTG | 0.001320494 | 0.009484133 | 6.00E-06 |
| 2057 | 2810394 | 2 | MAP3K1 | TGAACAGCTATGAACGAGGCCAGTGGGG AACCCTTACCTAAGTATGTGATTGACAA ATCATGATCTGTACCTAAGCTCAGTATG CAAAAGCCCAAACTAGTGCAGAAACTGT AAACTGTGCCTTTCAAAGAACTGGCCCT AGGTGAACAGGAAAACAATGAAGTTTGC ATGACTAAATTGCAGAAGCATAATTTTA TTTTTTTTGGAGCACTTTTTCAGCAATATT AGCGGCTGAGGGGCTCAGGATCTATTTT AATATTTCAATTATTCTTCCATTTCATAT AGTGATCACAAGCAGGGGTTCTGCAAT TCCGTTCAAATTTTTTGTCACTGGCTATA AAATCAGTATCTGCCTCTTTTAGGTCAGA GTATGCTATGAGTAGCAATACATACATA TATTTTTAAAAGTTGATACTTCTTTATGA CCCACAGTTGACCTTTATTTTCTTAAATA CCAGGGCAGTTGTGGCTCATTGTGCATTT TACTGTTGGCCCATTCATTTCGTTTTTGG AAATTATGGTTTTGTATTTTCATGTTTAT TTACATTCATTTTTGTTTATTCAGGGAAA GCTGATCTTTTTTTCAAACCAGAAAAAA AAAATGAACTAGATATGAAGTAGAGTTC ATTAAATATCTTGCTATTGTCAGAGTTTT TAAAATATAGACTTAATTTTGTTTTTTTA AATTGGAATACAATAAAGTACTACCTAC ATTTGAGTCAGTCACCACTCTTATTGTGC AGGTTAAGTACAAGTTAACTAAAAATAA ACTGTCCTCTCTGGTGCAACTCACAACC AAGATCAAGATTACCTTAAAATTTATTT GAATTTTTTAGATGTTTTGGTTGTCAAAC TGTAGGAAACTTCACAACATTTAAGTCT TACTCTGTATGTAACAATCCATCATTCAC CTTCACTACTGGTAGTAACATAGAGCTG CCATTTTCCTTTTACCATGCATCATCTCT TTACAGTAGGCCTGGCAGATCATTTTTTA AAAAGATTATTCAACTACCAATCAGTAA TGTTTTTAAACAGTACATTTGCTTTGAAC TTGGAAAATGTGTTCAGAAAGAAAAATG GAATTGAATTTCATTTATACACTAATTCC TTGGATTTTGCACAGTTACCTAACGGTTT TAGTCTGGAGTTAAATTCAGATGCATGG | 0.00010346 | 0.006765207 | 3.83E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AATCCTGAAGGAAAATGGTAGCTTTTTA ATCTTTTTGTGTGTGTGTGAGTCTTTTAA ATCAAGTACTGATTAACTATTAAGTACA ACTTTGAGATTTTAGTTTTAACTCTTCAG AAGCCAGTGTGAAATAGAATTGGTTATT CTCAAAGACTCAGGATAAACTAAATAAG CTATATATAGAGTACATTTAAAATGTAC AACACAAATTGGAAATAAAATAAGTTAC AAGATAAGTTTACAGGGATATATTGCTT ACAATTTTTAAAAGGCAGTTTGTTTTTA TGTGAATATGTTTCTTAGTGAAATTTTAC ATTCCTTTGTTTTGGAAGATTGGCGATAT TTGAAGAGTTAAAAATAGTACAGAAATG TGAAGTTTGGTATCTCTAAATGTGTTGTA CTTGACTTTCTTTTTATTTTGTTTTTTTT TTTTTTTGACTACTTAGAATTTTCACAAT TCTAATAAGATTGTTTCCAAGTCTCTCAT GTGCAAGCTTTAAAGGATGCACTCTTGC CATTTTATGTACTGGAAGATCATTGGTCA GATGAATACTGTGTCTGACAAAAATGTA AACTGTATAAACTGAGGAACCTCAGCTA ATCAGTATTACTTTGTAGATCACCATGCC CACCACATTTCAAACTCAAACTATCTGT AGATTTCAAAATCCATTGTGTTTGAGTTT GTTTGCAGTTCCCTCAGCTTGCTGGTAAT TGTGGTGTTTTGTTTTTTGTTTTGTTTTCA ATGCAAATGTGATGTAATATTCTTATTTT CTTTGGATCAAAGCTGGACTGGAAATTG TATCGTGTAATTATTTTTGTGTTCTTAAT GTTATTTGGTACTCAAGTTGTAAATAAC GTCTACTACTGTTTATTCCAGTTTCTACT ACCTCAGGTGTCCTATAGATTTTTCTTCT ACCAAAGTTCACTTTCACAATGAAATTA TATTTGCTGTGTGACTATGATTCCTAAGA TTTCCAGGGCTTAAGGGCTAACTTCTA | | | |
| 199 | 2810960 | 5 | PDE4D | GAGAAGGGTAAAAGTCTTCATGCTCTCC CACTCTCCAATGATGCTCATGAAA | 0.000625307 | 0.017332263 | 1.85E-05 |
| 520 | 2811016 | 5 | PDE4D | TGCCCAAATTGAAACTTGAGCCCTGGCT TTCAGACTCTGGAGCGGAGTTCTTCCTC TCACCCTTCAGCTAGCTGCATTAAGTCA ATCAATCAATAAATAACTTTTTATTGCCT GTTCTTTCTCTTCCTCCTCCTTATTCTAAT CAAGATATTTTAAGTTTTGAATTAAAAA TTTATCTCATTCTTATGGCAAAGTAGGTT TCAAGCCATTTCACGGAAATTTATACAA GTGCCTTTGTGCTACAATGGCTGAACCA GAGCACCCAGCTCTCAGGCAGTCCCCAC TGTGGAGACAGAGCCTGCTGTCCCACTG GACAGAGCCTCAACCCTGGCTGACTCAC AGCCCTGTGTATGTCACTTGGCAGCTTCT TCCAGTAGCATGTCCTTCCA | 0.000249584 | 0.013631798 | 1.22E-05 |
| 127 | 2811062 | 5 | PDE4D | TAACAGCATTGTTCCCATCCAGGTAGCA AGGTCAGCCCTTTCCATTGCCTCACAGG CCCTTGGAGCCCTCACAAGTGAGGATCT CATCTGTTACCCCCACCTCTCAACTCAAT CTCTGGTTCGCTACTAG | 1.71E-05 | 0.024255342 | 2.78E-05 |
| 1137 | 2811064 | 5 | PDE4D | AAATGACAGATACTGGCGAGGCTGAAA AGGGAATGCTTATACACCATTGGTGGGA ATGTAAATTAGTCCAGTTATTTTGGAAA GCAGTCTGGAGATTTCTCAAAGAACTTA AAACAGAATTACCATTTGACCCAGCAAT CCCATTACCAGGTATATACTTCCACAAA AATA | 0.009608615 | 0.007519077 | 2.39E-06 |
| 1158 | 2811075 | 3 | CTD-2254N19.1 | TGAAGTTCTTGAGAGCATCCCAGCTCTCT CTCTGTCTAAGATGTCACATCCCTCATTA CATCTCAATGTCCCTCTCAGCCTGCGCTC CCAGGCTCCAGATACAGCTGCGAAGCCT CTATTACAAACATATTCCTTTGCCGATGC TGACC | 0.001065067 | 0.007478452 | 5.17E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1896 | 2811116 | 8 | PDE4D | TGGATGTGTTCCGAGGCAACTCAGCATGTGCAGTTGGAAATGTGCCGCTTTTATTTGGCAG | 0.005601625 | 0.006976064 | 4.08E-06 |
| 1743 | 2811117 | 8 | PDE4D | AGTCAAATCTCCTCCAAACCAGACCCTT | 0.00811033 | 0.007133926 | 2.86E-06 |
| 1644 | 2811124 | 8 | PDE4D | GTTGCACTACGCGAATGGCCTTTGCTGACGTCTTCTGAAACAGGATTAGATATAGCCATGCAGCT | 0.001463501 | 0.006801354 | 4.84E-06 |
| 875 | 2811133 | 8 | PDE4D | ATCTATGATGCTATCAATCCTCTACTCAGAAAAAAAAAAAAAAAAATCACCGAAATGGTGTCTACA | 0.004194748 | 0.011585515 | 1.06E-05 |
| 1374 | 2811137 | 8 | PDE4D | CTACAGGTGTTAGTTTCTCTCCAGAAAAGAAAAAGCAAAATACTTGGATATTGAAGTGCTAATTTTAAATGTCTGTAAAAATTTGTGAGGGAACAAAGTTATTTTCTATTATGAATTTACTAAACACTAGATGACATTTTAAGCCATCATATGTTATCAATAAAAATTAGCACAAGAGAAATTCCAGCACAGGGCACAGGATATAGTAGGCAATAATATACCTTAGAGAGAGAGAAGAAGGAAAATGAGAGACAGAGGAAGGCTCTATTTTAAAATGACATAAATCATTTTCCTGATCTTGAAGACTAATGGAGATAGGGAGAAAGGATAAAATAAGCCCATGTAAAATTGCCTAGACTCTGAACAAGCAACAAG | 0.008310486 | 0.00749324 | 3.24E-06 |
| 587 | 2814538 | 6 | | CTACAATTTTGTGAGTAATGGGGACCACGGGCATGGGACAGTTTCACCCAGAGGAGCTGTGATCTCCCAAGAGACATCAGCAGTTGTGGTCTTGCC | 0.003217076 | 0.009592647 | 6.55E-06 |
| 679 | 2814695 | 9 | CARTPT | AGAGCTCCCGCGTGAGGCTGCTGCCCCTCCTGGGCGCCGCCCTGCTGCTGATGCTACCTCTGTTGGGTACCCGTGCCCAGGAGACGCCGAGCTCCAGCCCCGAGCCCTGGACATCTACTCTGCCGTGGATGATGCCTCCC | 0.001127536 | 0.009790303 | 8.15E-06 |
| 1334 | 2818565 | 9 | VCAN | GGTCCACAGACGGTAGTTTCCAAGACCGTTTCAGGGAATTCGAGGATTCCACCTTAAAACCTAACAGAAAAAAACCCACTGAAAATATTATCATAGACCTGGACAAAGAGGACAAGGATTTAATATTGACAATTACAGAGAGTACCATCCTTGAAATTCTACCTGAGCTGACATCGGATAAAAATACTATCATAGATATTGATCATACTAAACCTGTGTATGAAGACATTCTTGGAATGCAAACAGATATAGATACAGAGGTACCATCAGAACCACATGACAGTAATGATGAAAGTAATGATGACAGCACTCAAGTTCAAGAGATCTATGAGGCAGCTGTCAACCTTTCTTTAACTGAGGAAACATTTGAGGGCTCTGCTGATGTTCTGGCTAGCTACACTCAGGCAACACATGATGAATCAATGACTTATGAAGATAGAAGCCAACTAGATCACATGGGCTTTCACTTCACAACTGGGATCCCTGCTCCTAGCACAGAAACAGAATTAGACGTTTTACTTCCCACGGCAACATCCCTGCCAATTCCTCGTAAGTCTGCCACAGTTATTCCAGAGATTGAAGGAATAAAAGCTGAAGCAAAAGCCCTGGATGACATGTTTGAATCAAGCACTTTGTCTGATGGTCAAGCTATTGCAGACCAAAGTGAAATAATACCAACATTGGGCCAATTTGAAAGGACTCAGGAGGAGTATGAAGACAAAAAACATGCTGGTCCTTCTTTTCAGCCAGAATTCTCTTCAGGGAGCTGAGGAGGCATTAGTAGACCATACTCCCTATCTAAGTATTGCTACTACCCACCTTATGGATCAGAGTGTAACAGAGGTGCCTGATGTGATGGAAGGATCCAATCCCCCATATTACACTGATACAACATTAGCAGTTTCAACATTTGCGAAGTTGTCTTCTCAGACACCATCATCTCCCCTCACTATCTACTCAGGCAGTGAAGCCTCTGGACACACAGAGATCCCCCAGCCCAGTGTCTCTGCCAGGAATAGACGTCGGCTCATCTGTAATGTCCC | 4.84E-05 | 0.014054659 | 1.35E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CACAGGATTCTTTTAAGGAAATTCATGT AAATATTGAAGCGACTTTCAAACCATCA AGTGAGGAATACCTTCACATAACTGAGC CTCCCTCTTTATCTCCTGACACAAAATTA GAACCTTCAGAAGATGATGGTAAACCTG AGTTATTAGAAGAAATGGAAGCTTCTCC CACAGAACTTATTGCTGTGGAAGGAACT GAGATTCTCCAAGATTTCCAAAACAAAA CCGATGGTCAAGTTTCTGGAGAAGCAAT CAAGATGTTTCCCACCATTAAAACACCT GAGGCTGGAACTGTTATTACAACTGCCG ATGAAATTGAATTAGAAGGTGCTACACA GTGGCCACACTCTACTTCTGCTTCTGCCA CCTATGGGTCGAGGCAGGTGTGGTGCC TTGGCTAAGTCCACAGACTTCTGAGAGG CCCACGCTTTCTTCTTCTCCAGAAATAAA CCCTGAAACTCAAGCAGCTTTAATCAGA GGGCAGGATTCCACGATAGCAGCATC | | | |
| 951 | 2818582 | 2 | VCAN | CCTATCACCTCGAGAAGTAATTATCAGT TGGTTTGGATTTTTGGACCACCGTTCAGT CATTTTGGGTTGCCGTGCTCCCAAAACAT TTTAAATGAAAGTATTGGCATTCAAAAA GACAGCAGACAAAATGAAAGAAAATGA GAGCAGAAAGTAAGCATTTCCAGCCTAT CTAATTTCTTTAGTTTTCTATTTGCCTCCA GTGCAGTCCATTTCCTAATGTATACCAGC CTACTGTACTATTTAAAATGCTCAATTTC AGCACCGATGGCCATGTAAATA | 2.99E-05 | 0.013285949 | 1.06E-05 |
| 1039 | 2819807 | 3 | GPR98 | TTCCCTTGCCATTCTAAGTTTCTCACAGT ATTAGTGAGATTTTAGCAAATGGTGCCC TGCCTCCTTTTTCCCCTTCCCACACTTCTT TCTGTGTTGACAG | 0.000212853 | 0.010053274 | 4.60E-06 |
| 711 | 2820736 | 5 | MCTP1 | TTGAGCCAATAGCTGATGACTACTCTGTT ATTGATCTCTCAGTGTTACCACTTGCTGA GTGTTGGACCTCTGTCATCACGGCAAAG TACAAGATGCACCAGAGTCATCA | 0.000175608 | 0.010900573 | 6.10E-06 |
| 215 | 2820823 | 3 | FAM81B | CAGGCCAACGCAGCCATCTGATTCAGGT TGGGTTGCCCAGGGAACAGACTCTGAGA TGGAGATTGGCGAATAGAAGGCTTATTA CAGAGCACACTGGGATC | 0.027553244 | 0.01114295 | 1.20E-05 |
| 1601 | 2820990 | 4 | RHOBTB3 | CTCCCTCCTTCAGTCATAGTAGTTCCACT TTATCTGTTTCATATCTTGAGTTCTACCT AAAATTTTACTTCGTAAAAAAGACTCTG CTGGTAAAAGATATAAAAATCATATGGT CAAGATGGTGATTCCACCTCGGTGTAAT CCCAGCCAACTTGGGAGGCTGAGGCTGA AGGATCACTTGAACCCAGGAGTTTGAGT CCAGCCTGAGCAACATAACGAGACTTCT GTCTCTAAAAGAAAAAAGAGTAAAAATC TCTTGTTTTTATTCAGCTACTTGTGCAGT TAAAGAAAACCCAGGAACACACAATCC GTTTTTGGGAGATGTATTCAGCC | 0.013562644 | 0.007317207 | 7.76E-06 |
| 831 | 2821794 | 2 | RGMB | GATGTTTGTCCTGGGACACCCACCAGAT TGTACATACTGTGTTTGGCTGTTTTCACA TATGTTGGATGTAGTGTTCTTTGATTGTA TCAATTTTGTTTTGCAGTTCTGTGAAATG TTTTATAATGTCCCTGCCCAGGGACCTGT TAGAAAGCACTTTA | 0.000373569 | 0.013055543 | 9.09E-06 |
| 1496 | 2822927 | 1 | | ATGTACTTTGACAAGGAGTGTGTTGGAA ACGACTGCCAGCCTGTGCCTGCTGCCAA CTCCACTCAGCTACAAATAGAA | 0.000189098 | 0.008702002 | 3.67E-06 |
| 164 | 2823841 | 9 | WDR36 | CTCGTGAAAGTGACTGGGATGGTATCAT TGCTT | 2.38E-06 | 0.01812122 | 1.20E-05 |
| 827 | 2824081 | 1 | | AGACCTTCCATCCTGATCTGACTGCACTA AGCAATTGCTGACCTGCATCATTCTGGT GTGGAGCCCCAGGAGACAAGCAAAGA ATCCTTGGCCACAACTA | 0.000280435 | 0.009511252 | 5.20E-06 |
| 1781 | 2824971 | 1 | | TGCTTCTACCCATGCCCGAAGTGTAACTC CAACAAGTGTGGGCCCGAGTGCCGCTGC AACCGACGGTGGGTTTACGATGCCATCG | 0.046795588 | 0.006732733 | 6.92E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1124 | 2827090 | 4 | GRAMD3 | TCACTGAGTCAGGAGAGGTCATCAGCAC GCTGCCGTTTAATGTTCCTGACTA TGTAGCTGTATTAGACCTCACTTTTTAAC ATCTGGGACATGCTATGGGGTGGAGGTG GGAGGATGACATGAAATGTAATTAAACT AAATGGTCAAACTTCAAAGAGGTCAAAT GCTTACAGTAGCCTGCA | 0.008480701 | 0.006592995 | 5.52E-06 |
| 550 | 2827181 | 9 | C5orf48 | CCATGGGAAGATCGTAAAGTTGTCTTC CAAAAAGGCCCACCAGAAATAAAAATT GCAGATATGCCTTTGCATTCGCCTCTCTC CAGATACCAAAGCACTGTGATTTCCCAT GGCTTCAGGAGGCGACTAGTCTA | 0.000701725 | 0.010009205 | 4.36E-06 |
| 309 | 2827382 | 2 | MEGF10 | TGAACTTGCAGAACTCCCTCGGAGACGC AGGTTGCAGTGGACATTGGGATTGTTGC TTGAAAAATTAAAATTTGAATATTTTCTC TCTCATTTGCATCATACAGCTCTACCTAG GATTGTACAGTTTACCATAAAATTTACTT CATGAAAGTGGGAATCACTGAACATGTA GAAGACAAGGAACATATTGTTAACTCCT GATTCTTAACTTTATTCAACTGGACTCAG AATTGTAGGGATAATATGAATGCAGGAG GAAACATTCTGTCAGGCGGTATGACTGG ACAGACTTTGAATATACTCTAAAAGTGG ACAGAAAATTTACGAAAATCTTAGATTT TGTTTAGAATGAGAAAATATACAATTAG AATTATTTTAGAAATAGTAGGAAGTATT GCAGAAGTCAATACACAAATGTGCCAGG CAGAGGTGGTTTTCTCTGTTTGACTCTCA ACCAACTTCAGATCTATGACATTATTCTG ATCACTGGCTCCATCATACATATTCACCA CTTGAGATTCATAACATATCAATAGTTAT TTCATAAATATAGAAATGAAATAATTTT ATTTTTGACAGACTGGATGGAATGAGTG TGTAATGATTGATAAAGGTTGTAAATTTT AAATGCAAGATGACGCTTACGTTCTGTA AACCATTAGTAATACATGCTGTAATATA GAATTAGTGGAACATTTTGATTAATCTTT CCCTAGAAGTGACTGAAATATTTTTGTG CATATTTGAGAAAGGGAACTTTCCTTTTA TTAATTGTCAATTTAGAGAAACTATGCTT AAGCTGGTCTTTTGCATTGCTAATGTGAC ATGTACCCAACTTTTCATTAATTTGTATT TCCATTTTTAAATTGCATATTCTATGTTT TGTAGTGTTTGGATTGTTAATGAAAAAA TATTATATGTTCGTTATTCCTTGTATTATT GCCACTTATCTTTTGCTTGATAAAAATGC GTTGTTCTTTTTCTTTTGGAGGGACAAG ATGAAAATATATAATTTGAATTGATTAA AATTGGTCGTTACTAAAATAGTATAGTA ACCACAAGTGATTGGCTTATAAATGAAG TAGAAATGCTTTTTAATATTCCAAAATA GAGTTCCTTTTGATCTGTTGGTGCTGAGC CTTGGTTAAACCAGGGAGAAGGGGAGC AGAAAGGAAACGTTGTTACTGATGAGTA CCACAGACTCATCTTAAAAAAAACTCTC ATTATGGTGATCATAGAATTGACCATCC AAACTGGGACACTCTTGAGAGTAAATGG AGGGCATTATTAATAATTATCTTGTAATG AACTTAAATCTGGACTGTTCCAGGCAAA CCAGACTTATCTTGCAATATGAGAATGC TGACACAATGCAGGAAAGCCAGTTTCCC TTTTGTTGATCTACTTGACCAAGCAAAG GGGCTGAAAAACTGAATAAGGAAACAA CTTTATAAGAGAAACAGTGGTCTTCAAT CTTTAAAGACATGAAATCCTATATGGC ATTCTGTCTCAGTGAGTCAGTTAACAAA TACGTATGTGCAACCCTTCTGCTAGTAGT GCACATAAGTGATTATCCCTGCCAGGTA TCGAGTTGGAATATCCAGTTATTTCATGT CACACATCGGCACGTATGATGGTGGTTT | 0.00195225 | 0.012497339 | 9.89E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GGTCAGATGGATAATACAGCAGACACAC TTAGAACACTCACTGCACTGGTGGCTGT TCATTTTGAGGAACTCCAAAGTCAATTC AAGGAAATAAGGAATGACCTGGAACAG GCCTTAGAAACAATTGATTTATTCCAAT AGTTAACCACTGGCTGGCTCCCAACTCT AGGTGATAGGCATCTAATTGAGACATGT GTGAGTCAATAGCCATCGGGGTCCTT | | | |
| 1752 | 2827801 | 9 | ADAMTS19 | GATTATGGTGCAAGGTAGAAGGTGAGAA AGAATGCAGAACCAAGCTAGACCC | 3.34E-05 | 0.008103524 | 2.94E-06 |
| 1361 | 2828481 | 2 | SLC22A4 | GGCTTCGCGCCCAATTTCTAACAGCCT GCCTGTCCCCGGGAACGTTCTAACATC CTTGGGGAGCGCCCCAGCTACAAGACAC TGTCCTGAGAACGCTGTCATCACCCGTA | 0.015786268 | 0.007598853 | 6.85E-06 |
| 570 | 2828804 | 2 | LEAP2 | AAGGACAGCCAGTCACCTCCGACAATGCT CCGTTCTATGGAATATTGA | 0.021355142 | 0.006802107 | 3.41E-06 |
| 1010 | 2829040 | 1 | | AGCTAATCTAGCCTGGGCTCGGTTGTAC CAGACTCAACTCCAGACTTCTTGTCAGA TTCACATTTGCCCGCGGTCTTCATTCA | 4.84E-06 | 0.011084794 | 9.79E-06 |
| 1841 | 2829806 | 4 | CTC-321K16.1 | GCGCATGGTCATCTTAGCTTTCGAAAGA GGACTGCACTGTTTAACATTGAAGAATT ACATGGGGAATCACAAATATATTGCTTT AGTACTGCATGTTCTGTTGTGGTGAGGG AAAGAAACATGCTTTGAAGGTTTTCCCT TGTCAACAGAATGTGTGTCTGTAGCTGT GTATTGCGCATGTA | 2.01E-05 | 0.007691385 | 6.15E-06 |
| 1053 | 2829898 | 5 | IL9 | TTGTTGATGAGGAAGTTGATGTCCAGGA TCCCCGCCAAGGTTGGACACCCCTGGCC TGCCACGGAGCACAGGAGCA | 0.000185636 | 0.007264838 | 4.67E-06 |
| 1184 | 2830875 | 9 | EGR1 | GGGCGAGCAGCCCTACGAGCACCTGACC GCAG | 0.012281121 | 0.006583967 | 3.65E-06 |
| 128 | 2832532 | 7 | TAF7; AC005618.1 | CGCCTCGGGTACTTACAATCCAGTGACG ATTATAAGTTCAGTTTCACCGGGCCGGA GCGAAGGGAAGAGGAGGCCGCAAGGAG CCAAGCGGGAGAGAGCCGAGCGTCTCCT TGTCGTTTCCTTAATTCTTCCTGCCGCTT GGCAGAGTGATCCACTACCGATTACTGA TGAAAGGGCCCGGGATGGGCAGCGCGA AATCTTGCCGAGAGGCGCAGCTCGCATC ACCAGACCCCGCACCTCGCCGGCCCTCC GTCCGGGTCGCCTACCCAGCAAAAACGG AAGTG | 0.001173835 | 0.021583374 | 2.37E-05 |
| 466 | 2834899 | 4 | ABLIM3 | TCCGGTTGGCTAGGCCTGAATTCCCAGC AGTTTCCAAGTGCCTTGGACGTTGGCTCC ATTTCCGGACCCTCCTCAGACATTCATTG AGCAACAAGCTGATGCTAGGCTTGTCCC ACATTCTC | 4.52E-06 | 0.012756132 | 5.66E-06 |
| 680 | 2835934 | 7 | SPARC | CCTGTGAGATCCGACCATCCCATTAACTT TGAAGTTTCTCTTGATTAATAGAAGAAA AAAGGGGAGGGTGAAGAAAAGGAGGAA CATGCTAAAAACCTTATGACAATATCC AAATGTGAGGAAAGAACAACCGATTCAC CAACTCCACTTTTTCTATTTTACAACTTT CTACATCTCACTCTTGATTTTGGCCTTCC TGGCTGAAACAGCCTGGCAGTCCCTAGA GCCCCTGAGAAGAGCCCTGGTTCTCCAA AAGACAGAGGAGGAGAAGCCCTGCAGG ATGCGCTGACCACTTCCCAGAGAACTGA CAGTCCGTGCTCCCAAAAGTTTGAACCA ACAGCCTAATGTGAAAAGAAACTGCACT GAAAGGTAAAGGAGGAAATGGTGATGA ACTGGGCTTATGTGAGAATGTCTATATTT TCATAACACAGCCCCAGAATCTTTCTCTC AGTTACAGCCTCAGGCA | 1.72E-06 | 0.018740722 | 2.49E-05 |
| 1483 | 2836555 | 4 | GALNT10 | AAATGACCTTTTCTAGAGCCACCTACAC CAAACAAAGGAATTGGAGGGTTGATATG GTTCTGCCCTTGG | 0.001171064 | 0.007953627 | 3.86E-06 |
| 2012 | 2836811 | 9 | LARP1 | CAAGTTGTTTGGTGCTCCTGAGCCCTCCA CCATCGCCCGCTCTCTACCAACCACTGTC CCAGAGTCACCAAACTACCGCAACACCA | 5.49E-05 | 0.008860871 | 6.50E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 904 | 2840276 | 4 | KCNIP1 | GGACCCCTCGCACTCCCCGGACACCACA GCTCAAAGACTCAAGCCAGACATCACGG TTTTACCCAGTGGTGAAAGAAGGACGGA CACTGGATGCCAAG ACAAAGTTTTGGACACTAGGCAGGCTGG AATTGAGGTGTTGCAGCTGTTTACTGGA ATTGTCTGGGAAAGCAGAAGCCTTCACA CTGGGGACTTTGAGACCTGTGAGATATC ATCATCCCTCTACCAAG | 0.003724362 | 0.007065134 | 1.81E-06 |
| 1911 | 2840930 | 7 | FBXW11 | TCCAGAGTATGGCTGGGAATTACTATTA TAATCCCAGAAAGTCAGAACTCCTTGGA TGCCAAAGTCCCCTGCTATAATTTAGTA GGCACAATTCAAAGGTTGTCTGCATATT CAAAGGCCATCATCTCCCAAGGAACGAG GGGAACTTCTATATTAAACATGCAAAAA CAACAAAAAATCCATTCATTCATTCAGA ATTGCCTCCTCCCCTGCCCCTCCCTTCC CCCTGGGCTTTCCTAACCAGTTTGATATT GAAGCT | 0.000269075 | 0.007625411 | 4.11E-06 |
| 455 | 2842772 | 4 | UNC5A | GTGGTGGCCCAATTGTCACAGCCTCCTC AGCCCTGGGAGCTCACCACACTGTGCCA CAATGCCCCAGCTTGAAGTGACATGGGA CACTAAGTGTATCTGTTGCAAATATTAG AACCCAACTCACACTGGCTTAAGGAAAA AAAAGGAAAACGAAGAAGAAGGAGACC ATAATGGCACATGGAACTGAACTCAGGG GTGGCTGTGGCTTCAGGCATGGTTGTAT CCAGGGAACAGTATGGCCAAGATCCT TCCCTCA | 0.001157296 | 0.011866543 | 6.61E-06 |
| 1798 | 2844247 | 2 | CANX | ATGTCTGCAGGTTTCTCCTTGAAGCAAAT GTGTGGGATCATTGCATTTCCAGAAATC TGCCTCCTTCACCCTCCGTTGACAGTATA TGTCATGCCTCACTTTC | 9.77E-05 | 0.009485266 | 1.11E-05 |
| 1222 | 2844255 | 4 | CANX | TACCCGATGGATTTGTGAGGATTAAATT AAGATATGTATACAATAAGACAGGGAA GTCCGACATTTAGTAACTGCTCGATGAT CATTGCGGTACGTTA | 0.000636171 | 0.00806974 | 3.62E-06 |
| 1615 | 2844539 | 2 | SQSTM1 | GCCCAGCACATAGCTTGCCTAATGGCTT TCACTTTCTCTTTTGTTTTAAATGACTCA TAGGTCCCTGACATTTAGTTGATTATTT CTGCTACAGACCTGGTACACTCTGATTTT AGATAAAGTAAGCCTAGGTGTTGTCAGC AGGCAGGCTGGGGAGGCCAGTGTTGTGG GCTTCCTGCTGGGACTGAGAAGGCTCAC GAAGGGCATCCGCAATGTTGGTTTCACT GAGAGC | 0.002162534 | 0.008729973 | 9.01E-06 |
| 211 | 2844540 | 2 | SQSTM1 | ACATAGTCGTGTGGGTCGAGGATTCTGT GCCTCCAGGACCAGGGGCCCACCCTG CCCAGGGAGTCCTTGCGTCCCATGAGGT CTTCCCGCAAGGCCTCTCAGACCCAGAT GTGACGGGGTGTGTGGCCCGAGGAAGCT GGACAGCGGCAGTGGGCCTGCTGAGGCC TTCTCTTGAGGCCTGTGCTCTGGGGGTCC CTTGCTTAGCCTGTGCTGGACCAGCTGG CCTGGGGTCCCTCTGAAGAGACCTTGG | 0.036159066 | 0.011382357 | 7.36E-06 |
| 1645 | 2844718 | 4 | CNOT6 | TCCAGCCTACTGTTGATGGCAGCTAGGT TGATTCCATGTTTTTGCTATTGTGAATAG TGCTGCAGTGAATATACCAGTGCATGTA CCTTTTTTGTAGAAAGATTTATTTTCTTT GGGTATAGAACCAGTAATGGAATTGCTG GGCCAAACGGGTAGTTCTGGTTTTTTATT TATTTATTTTTATCTGTCTGTCTATGTATC TATCTGTCTATTGAGACAGAGTTTCACTC TTATCACCGAGGCTGGAGTGCAGTGGTG TGATCTCAGCTCACTGCAAACTCCATGTC CTAGGCTCAGACGATCCTCCCAAGTAGC TGGGACCACAGGTACATGCCACCATGCT GGCTAATTTTGTATTTTTTTTTTGTAGA GATGGGGTTTTGCCTTGTTGCCCAGGCTG GTCTTGAATTCTTGGCTCAGGTGATCCGC | 6.32E-05 | 0.006891649 | 2.87E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1525 | 2845394 | 4 | SLC9A3 | CCTCGTAGGCCCCCCAAAATGCTGGGAT TGTAAGTGTGAGCCACTGGGCCTGGCTT AGTTCTATTTTTA TGTCCCACGGGTTCTGGCCTTTCCACCAG TGCTTCCGTCCCACACGAACACCTTAGA GCTCCGTGGCAGCGTACGGCCACGTTTC CTTTCCCACACAGCATCTGGCTTTGCCTG GAGGGAACGATGGTCTCTGTCGCTGCTC TTG | 0.000104877 | 0.007173792 | 4.58E-06 |
| 635 | 2845607 | 4 | BRD9 | TTTGACACTTTGCTGCACTTGGAGCTGTG GGCCATTGTGCACGTGCCTGGTGGACAG TCCTGACCCTCGCTGTCTGATAAAAAAG CACTGGCCACATGGCCGCTGGGAAATTT GAATGTGGCCAGTCTGAATTTAGATGTG ATGTGTGAGCTACAAACTAGATCTTAAA AAACTAATGCAAAAAACGTAAAAATATG AGTAACGATTTCTTATGGCCCACATG | 0.001877871 | 0.010609655 | 7.35E-06 |
| 1484 | 2845672 | 5 | NKD2 | GATCTTCTACAAGAAACTGCTCCCACTG ACCAAGAACTGGGCATCCCACTG | 0.001354972 | 0.007318934 | 3.90E-06 |
| 1221 | 2845675 | 5 | NKD2 | GGGTAGGCTCTGTTATCCAAAAACAGCT GCTGTAGCTCTTGTCACGTCCCCCTTAGC GGATGTGAGAGGCCTCGTCCTGGAAGTA CATCCACGCAGGACCACGGCCTTAAGGG CAGGTGGGAGCCCTGGAGGGTCCTGCCA GCTACCGACGTGAGTGCCTCACGGAGAA CCTCACTGGAGACAGCAAGGAGGGACCC CCGTTTCCATCGGCCTCTGGCAAGGCTCT CAGTCTAAATCCG | 0.009101689 | 0.009826739 | 8.25E-06 |
| 1536 | 2846862 | 1 | | TCTCCATGAAGCCAAACGTGGGTCCTGG | 4.46E-05 | 0.007535106 | 1.50E-06 |
| 1185 | 2847247 | 1 | | CCATGCCAGTCTGAGCACTCCATTTAATT A | 0.033429032 | 0.007973611 | 7.35E-06 |
| 1897 | 2847334 | 6 | | CAGCCTGTGGCCTGTAAAGCATATATTT CTAATGACTGCAGACTGGTGGGATCATA GGAGCCTTCTGAATGACCAGGACTGCTT TCTTTGGAGCTGATGAAAATGTACTCTTT TAGCGTGTTAGAAATCACTTGTTTTATTT TGTTTCTTTGGCCAAGCTGGGTCTAGTGT TTCTTTTGCTGGGAATAGACTTTCAAAAG TTGTACTTCTATCAAGAAACAAAACTGC CCTTGCAGAAATTTCAGGTCTTTTGTTAA GCCTGTATTGGTCTTAAGGTGCAGTATTT TTTAAATTATTATTTATAGAAAGAATCTA TAAATTCTTGGGGAAGTGTGTTATAAGC TTTAATAATTACATTGAGCTGCACCTCAG TGGTGTGTCATTAACATGCAGTGGGGTT AATATCTGAGGCCTC | 0.001587412 | 0.006770776 | 3.66E-06 |
| 818 | 2848815 | 9 | CTNND2 | TCAGCCTCAGAGAAGACGAGTTCCCTGA GCCCCGGCTTAAACACCTCCAACGGGA TGGCTCTGAAACAGAAACCACCTCTGCC ATCCTCGCCTCAGTCAAAGAA | 0.000155817 | 0.007745231 | 4.67E-06 |
| 1032 | 2849087 | 9 | DNAH5 | CCTGAGATAAGTGCCCGTACCTCCATCA TTGACTTCACTGTCACCATGAAAGGTCT AGAAGATCAGTTACTGGGGAGGGTCATT CTCACAGA | 8.61E-05 | 0.00794934 | 5.03E-06 |
| 1333 | 2849099 | 9 | DNAH5 | TTCCTATGATATTGACTGCAGTTTGGAAA TCAAGAAGGAGGTGGTCCAATGCATGGG CTCCTTCCAGGATGGGGTGGCTGAGAAG TGTGTTGATTATTTTCAGAGATTCCGACG TTCTACCCACGTGACGCCCAAATCATAC CTCTCCTTTATTCAGGGC | 0.040101547 | 0.007167069 | 3.66E-06 |
| 1285 | 2849102 | 9 | DNAH5 | GTGTCATTCGTACTCCTCAGGGAAATGC CCTCCTGGTCGGGTGGCGGATCAGGA AAGCAGAGCCTGACGAGGTTGGCTTCAT TCATTGCTGGCTACGTTTCCTTCCAGATC A | 0.002537394 | 0.006928127 | 3.69E-06 |
| 841 | 2849152 | 9 | DNAH5 | GAAGAAGCCCGCGAGTTACTCTCTCATT TCAACCATCAGAGAACATGGATGCTCTTCT GAAAGTTACAAGGAATACACTAGAGGCC A | 0.013562644 | 0.007538097 | 6.90E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 145 | 2849177 | 3 | DNAH5 | GGCGACTGTCCTAGGAGTATGACCAACC CTCCTTCAATGCTAGGCTTCAGCCACCTC CTCCTGAAAGCTGTCCTGTCATCCCCACC CCTACCCCTTATCAACTCCAGGCTAGAG TGGGAGACCCTTCTTTTTGCTCCTTCTCT GTAGACCCATAAATGCCCCTGCATTTGG AGACCCATAAATC | 0.000297559 | 0.019731072 | 9.73E-06 |
| 460 | 2849511 | 4 | ANKH | AGTGAGTTGGGTTGTAAGGAGAGTAGCA CGGAGCCATCAACAACCACGCAAAATGT CAGCATCCCTGAAGGACGGAGTGGAGGC TTAG | 0.006926925 | 0.010661478 | 7.13E-06 |
| 1611 | 2849802 | 5 | FBXL7 | TCTGGTAAGGCTAGAAGGTCATGCGAGA AACTGTATGAAGAGACACAGAGTAAGG ATGGGCATGAGAGATGAACACGAACAA GTGTG | 0.001124866 | 0.006581459 | 5.10E-06 |
| 117 | 2849995 | 2 | FAM134B | TCTAGGAATCAGCTTGCAACAGAGCACA AA | 0.00014459 | 0.026361181 | 3.38E-05 |
| 1701 | 2850497 | 6 | | GCTACTCAAGGAGACTCAATACAGGGAC CTCAGACCCACTGATCAGT | 0.008143382 | 0.007243822 | 3.72E-06 |
| 503 | 2851189 | 1 | | AGTTGCATCTTCCAGGGAAGCAGGCTCC CAGTACTTTAGTCAGCCCCAGTGGC | 0.000191608 | 0.011471627 | 7.40E-06 |
| 944 | 2854889 | 2 | HEATR7B2 | CCATTTTGTTGGTTAGCAGGAGTTCAGA CGCAAGACAATGTCATAGTGGTAGAATA CAGTATCAACTTCAACAGCAAGCCCATC TCTGGAAGCTCCCAGACCATTGTGCCAA TCAAGTGGAGGAGGCACTTTCATTTAGA GAGGCTTATGTGAACCTTATATGAGAAA CTTGCCAACCTGCCTCTTTGATTTTTAG CCTTACTATTTCTAATACTTAGGTGCTAT CTTTTAGAGACC | 0.030501101 | 0.007657939 | 3.05E-06 |
| 1012 | 2856493 | 4 | MOCS2 | GTCAGAAGAGGAATATTGCCCGGTTTGC CAG | 0.000310049 | 0.007523726 | 3.12E-06 |
| 739 | 2856671 | 4 | ARL15 | TTACTCGCCTTCAGGTGTCATGTTCTTGT TCC | 0.001095886 | 0.007898792 | 4.05E-06 |
| 1390 | 2857094 | 4 | RP11-528L24.3 | TGGTCGTGAAGGTGGTAAACCCAGCCAA CTGTCAACGACTCTCCAGCAACTCATCA AAGAGTCAGCCTTTTCCATATTTAGGAC ATTTCTCTCCCCCGTGGAGAAGTCGAAC CGCTGGATCTACATAGCGCTTTATCTGG GATCG | 0.003174906 | 0.006645723 | 3.59E-06 |
| 1101 | 2858235 | 4 | PDE4D | AACATAGCCCTACGTTCCATGAACACTC AGTAACATCATCAAAACGTGATGCAATT AAATTTTACCAGGTTTACTGCTGTCCTGA TGCTTTCCAATTTTTTTTGACAACAGTTT TGCCTTTTTCAAATTCAAATGGTATAATT GGGGCTTGGTAGTTGATGTTTATCTTAAT TGAAACAGATTCTCTTCATCCTTTTGCTC TGAGACTCCCACTTTGAGGCTGAAAGGT CATTTTAAATCTGCAGAGCACTCGAGAA GCCAC | 0.001709174 | 0.007746921 | 6.08E-06 |
| 476 | 2858299 | 4 | PDE4D | CCCTTGGACTGGGAGTTTAGCACTATCA CCTGCACACTAGACCTGCAGTCTATGAA GAGAGGCTGTCAGGGATTTGGGGCTATC ACAGTTGCTCCTCCCAGAGCAAAAAATA TTCAACCCTCCCACACACACAGGCAGCA GCCTCATCTCAAATGGACTG | 0.016744596 | 0.010941528 | 4.86E-06 |
| 368 | 2858312 | 4 | PDE4D | TGAGAGGAAGAACTCCGGCTCCAGAGTC TGAAAGCCAGGGCTCAAGTTTCAATTTG GGCATTTCCCAGCTTTGAACAACAGAAA AACACTGTTTACCTTTTCAGAACCTCAGT TTCCTTAGATCTGTAAATTAGCAATAAA AACTAATGTGCCTTCCAAGGTTATGGTA AAAATCAAATATCTTATGCCTGTGTAAA TCTTTTTCAAAAAACAATAGACACTGCA AATATTGGGCATTCTATGATGATGTTTA TTCTTCACTGGGAGCATTGATGGATTGAT TGTTACTTTTCAATAACTTTTTCCATATTT GCTCTAGTTTAAATTTGCAAATTTTAAT TCAGTATTGTTTATAATAAGACAAAAGC TCTTCTTTAAGGTTGGGGCATTA | 0.007144307 | 0.010799351 | 6.79E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 436 | 2858317 | 4 | PDE4D | CTTTCAGTGTTCTCAGTGAGTGCTTCACAGATTAGGTTTCCAAGAGAAGAAGATTGCCTCTGAGGAAGAAGAGATGGGGTAGCAAGAGGC | 0.000553994 | 0.012556713 | 8.30E-06 |
| 469 | 2858354 | 4 | PDE4D | AAATGAGAAGTAACGTCAGCAGCTCCGTAGGTTCTGA | 0.000367918 | 0.014805117 | 1.60E-05 |
| 1605 | 2858355 | 4 | PDE4D | ATATTAGGCTCAATTAGAGAAACAATAAAG | 0.01732465 | 0.007281016 | 1.82E-06 |
| 1360 | 2858366 | 4 | PDE4D | AGCTACACAGGAAATAACACCACCAAAAATAACACATTCAAACTCAGAGGGCAATCTTCCCTAA | 0.006926925 | 0.009640878 | 7.22E-06 |
| 1445 | 2858387 | 4 | PDE4D | GGGGAATGCAACTGAAATTGCTAGGAGTTGAGTCAGGCAGCTATGAGCAA | 0.001543869 | 0.009130611 | 7.79E-06 |
| 1392 | 2858392 | 4 | PDE4D | GGCCCAGCTTCATGGATATACAAACTATACATTCACATGGGTTCCACACCTAGATGGGCTCTTACATCATGTAGCTGGTCCTACCTGGGAGAGAGC | 0.000931652 | 0.008377171 | 7.70E-06 |
| 1867 | 2858399 | 4 | PDE4D | CAATCATTATGTTGCATGAGGTACAGCCATATGAATAAATATGTACTAACACATACCTAGACATACACAATCAGCCCT | 0.001283816 | 0.006649943 | 4.90E-06 |
| 507 | 2858418 | 4 | PDE4D | AACAGAACAGAAGTTAGGAATGGTGAAAT | 0.000328031 | 0.013378586 | 4.08E-06 |
| 835 | 2858532 | 4 | PDE4D | CTGGTGAAACGTCCAGCCTTATGGAGTAGGCCCTGAGGTATAGAAATGGTTTTGATGGCATAGGATGTAGCCTTGGGAATGTCCTGGAAGAGTAGGAGCGGCCAGTTAGGCATTAACACTCAGGAGTAAGGAGACTGCATT | 0.000984436 | 0.01321077 | 1.06E-05 |
| 1720 | 2858540 | 4 | PDE4D | ACCTGGTCATCTTCCCCTACATTGTAGCCTACCAGAACTACCTGGGCTGTAATCTAATAT | 0.000720832 | 0.00689557 | 3.83E-06 |
| 398 | 2858550 | 4 | PDE4D | CTAGGAGAAATGGTAACACGCAAAGATTGGTATCAGTTTACACCAAAACAGAACACA | 0.000175143 | 0.015741974 | 1.65E-05 |
| 563 | 2858551 | 4 | PDE4D | AAACGTATACCAGAGACGAAGAGGCACTTTGAATTTGTCCGGGTAGGTGCTTCTTGGTTTGGGGATGTTATGACCTTAGATA | 0.00160589 | 0.011660697 | 6.79E-06 |
| 1566 | 2858567 | 4 | PDE4D | GAATCCCTAGATCCAACTTTCTTTGGTGAGTTTGCAGGGGTTTCTGATGGTTCTCTTGTTTCACGGGTT | 0.001752996 | 0.008574915 | 4.99E-06 |
| 360 | 2858575 | 4 | PDE4D | AATCTGAAAGGGCTTGAAAAGTTAGGATGTAGACTG | 0.000142286 | 0.016665493 | 1.59E-05 |
| 973 | 2858577 | 4 | PDE4D | AAGTGTGTCTGAATGACTTCGCATGTTTAGTGAAGCTCATTGCCAGAACTGCGACTTCCCCTGTTGCCTTGAATCTGCTGATCAGCCCTGGCAGCACAGTTTTTTAAATTATTTAAAAAGGGACAAGGGTTATAAAGATGAAAACCACATTTTTACCAGCCTCTGCAAACTCCTAATTTGGTGGGTG | 4.53E-05 | 0.013041407 | 1.47E-05 |
| 1466 | 2858619 | 9 | DEPDC1B | TGTGGTACAAGCGTCACAGTATTGCAATTGGAGAGGTGCCAGCTTGCCGTCTTGTCCACCGCAGACAGCTGACAGAGGCCA | 0.019828743 | 0.007090047 | 4.33E-06 |
| 384 | 2860275 | 3 | RP11-83M16.5 | GGAGTCCATGTTGCCTCGCCTGGTCTTGGACTATT | 0.038217335 | 0.014699721 | 1.45E-05 |
| 262 | 2860360 | 1 | | ACCAGCATCTCGAGCCCTGCCCTTTCCACCCAGGACACCAAATGGGATGCTGGATCAGTTGCTGAGACAATGGCCAAAGGGTCAGCTGGA | 0.004426107 | 0.013556498 | 1.14E-05 |
| 1372 | 2863463 | 2 | ZBED3 | ACGTGTGAATGCAGCGCTGTGTCTTTAAGGGGCACGCGCGGAGGTTTTCCGTCCGGGACAAAATGTCAGCGAGGCGCCTGGAGGGGGATCTACCATCTCGGACTCCCGA | 2.19E-05 | 0.008828438 | 5.87E-06 |
| 253 | 2863936 | 4 | LHFPL2 | ACGTGTCACCGGACTGACTTCTAGGGCCAGTCACAGAAAGCCATGCAGTTCCTGTCTTGTTGGAAGGAACACTGCTCTTCAAGCCCTGAGCTCCGCTTCGTAAGTCAACTCCCCTAAGGCCATCATGGCAGGAGAGGCCATATCTGGGCGCTTCAGTGGATGTTCTTATCTGACCCAGCCTTCCAGCTATCCCCACTGACATGCAAACCAAGCCTCTAGACCAGC | 1.57E-06 | 0.015136691 | 1.37E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 374 | 2864082 | 4 | ARSB | CCGTCCACCGGCCGAATGCTGCCTGTGA CCGACCTCTGCCATTGCCACATGGAACA GAAGCACCTCCCAGCTGC TTGGCCGCTATTTGCTTACACTTGCCATC TGTGCAACCGCTCTACCCGTGGCCTCCCC CGCTTTGTGGTTGTCTTCTAACAGGAGCA GTCCACGCAAAGCCTTCCTGA | 0.001480634 | 0.012463709 | 7.11E-06 |
| 336 | 2864402 | 1 | | CGAGTAAAGATCTGCACGCACAGTTGAT GGACAAACTCATACGGGGCAGTTTGCCT GCTGGGCTGGCACACACGTGGTCTACCT TGGGAATCCTAAAGGACAAAGAGTTACA ACCTCCACGACAGGCCTTTGCCGTGTAT CCC | 0.004699102 | 0.012757132 | 1.00E-05 |
| 1733 | 2869244 | 7 | PAM | CAGCCGCTACTTCATGGCCCGGGCACGG CGGGCGTCCTGCGGCGGCCACACACAGT CCGCCAGCGAGAGCAGCGAGCTGGCCGC GGCGAGGCGTCTCGGTCACGAGCGGCGG GCAAAAAGCCGTGGGCAGGCGGGACTTT TGTCCGGCCCGCAGGCGGAAGCTT | 0.042209752 | 0.008127007 | 4.53E-06 |
| 1424 | 2869909 | 4 | EFNA5 | AATTTAATGTTCTACCAGAAAGTGCTAT GCATATGTAAGTATATTTCTTCAGCTTTT ATGCCAGAAATTCATATTTAAACTAAAA CAGAAAAACAATAGGCACCTCCCACAG | 0.000722593 | 0.010990528 | 7.75E-06 |
| 756 | 2870559 | 1 | | GGGTGGTCCTCTAAAGAATTGCAACTTC TGGCCCTTGAAAAA | 0.004851623 | 0.009976688 | 7.50E-06 |
| 1979 | 2871561 | 5 | KCNN2 | AAGTCAAGTATGGTGAGAAACATCCAGA ACACACAGGACAGTCCCACATGAAAAA GAATTATTCAGCCAAAAAAGTCACGAGT GCCAAGGTTGAGAGGCCCTGGAATACAG CAACTACACTATAAAACCAACTTGGAAT GTCTCCCAAATGAAACTGGTTGACCTCG GTGAACTTCATAAA | 0.017956371 | 0.007538282 | 3.77E-06 |
| 304 | 2873260 | 7 | CSNK1G3 | GCTGCTCGGATTCGGTCCCTGCACTGCC GCTGGTGCCTCCTACCGCCGCCGCTGGC CGGAGAGTCGCCGCCCGAGCCTCTGCTG TCGCCACCGATGCAGCCCGGAATGAATG CACAGCAGCGCCTCGCTTATCCGGAGGT CAAACATCCTTCTG | 0.001286836 | 0.013895424 | 1.35E-05 |
| 1503 | 2873713 | 4 | RP11-114J13.1 | GAGAACAAGACTTTTGGTGGGACTGGAT AAAGACA | 8.45E-05 | 0.006843065 | 4.69E-06 |
| 2056 | 2873861 | 7 | LMNB1 | GGAATCCATCATCCAGAGTGCTTACATG GTGATTAGGTTAATATTGCCTTCTTACAA AATTTCTATTTTAAAAAAAATTATAACCT TGATTGCTTATTACAAAAAAATTCAGTA CAAAAGTTCAATATATTGAAAAATGCTT TTCCCCTCCCTCACAGCACCGTTTTATAT ATAGCAGAGAATAATGAAGAGATTGCTA GTCTAGATGGGGCAATCTTCAAATTACA CCAAGACGCACAGTGGTTTATTT | 0.001797859 | 0.008557564 | 6.17E-06 |
| 540 | 2874627 | 4 | CTC-575N7.1 | CCAGAGTGGGACTAACTGGACTTGAAGG ACTGATTGAGCCTGGATTGGATGCCAAG G | 0.007850273 | 0.012194012 | 1.37E-05 |
| 1019 | 2876122 | 5 | SEC24A | CCACTATTATAGCACTGTTTACATGTGTC CAAAGAACCACCAAAAACCACCACAA TGATACAGGTATCTACTGCAAATTTTCTG CTTCTTGTCTGCTACCTTGTAAAAGGTAC AGCCTCCAATTA | 1.65E-05 | 0.008469393 | 7.83E-06 |
| 891 | 2877487 | 4 | ETF1 | TCTTTGAACTTGAGATTGAGGATCGGCC CAGTACAGCACCAC | 0.002849134 | 0.008531733 | 6.73E-06 |
| 1558 | 2877961 | 2 | DNAJC18 | GCTGGATGGGGCAGCATCTCAATCATAT AGGGCACAGGAC | 0.003692121 | 0.007016632 | 2.32E-06 |
| 692 | 2878005 | 2 | TMEM173 | AGAAGCTGCCCTTGGCTGCTCGTAGCGC CGGGCCTTCTCTCCTCGTCATC | 8.12E-06 | 0.010978292 | 9.08E-06 |
| 775 | 2880995 | 4 | CSNK1A1 | AAGAACCCGGTGCATATAGGCGATCCGC TGAGGGAAGCACGGAATGGGAAGTGG GTAGAGGCAGGTAATGAGACCAGCTGA ATCCGGGTCTTGGTGTTTTA | 0.000385118 | 0.010477403 | 7.49E-06 |
| 684 | 2881838 | 1 | | TTGGGGTTGCAGAGGCTATAGCCTCCAT GGGGGTCTTCATCTGCATGGGCTTCTGG CTCCCGTCTGCTTTGGGTTT | 0.00021174 | 0.007683315 | 6.31E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1997 | 2882121 | 2 | SPARC | TGGTGAATCGGTTGTTCTTTCCTCACATT TGGATGATTGTCATAAGGTTTTTAGCATG TTCCTCCTTTTCTTCACCCTCCCCTTTTTT CTTCTATTAATCAAGAGAAACTTCAAAG TTAATGGGATGGTCGGATCTCACAGGCT GAGAACTCGTTCACCTCCAAGCATTTCA TGAAAAAGCTGCTTCTTATTAATCATAC AAACTCTCACCATGATGTG | 3.72E-05 | 0.008293392 | 7.47E-06 |
| 115 | 2882122 | 2 | SPARC | GCTGTTGGTTCAAACTTTTGGGAGCACG GACTGTCAGTTCTCTGGGAAGTGGTCAG CGCATCCTGCAGGGCTTCTCCTCCTCTGT CTTTTGGAGAACCAGGGC | 5.12E-06 | 0.032841204 | 3.86E-05 |
| 2054 | 2882125 | 2 | SPARC | CCACAGTACCGGATTCTCTCTTTAACCCT CCCCTTCGTGTTTCCCCAATGTTTAAAA TGTTTGGATGGTTTGTTGTTCTGCCTGGA GACAAGGTGCTAACATAGATTTAAGTGA ATACATTAACGGTGCTAAAAATGAAAAT TCTAACCCAAGACATGACATTCTTAGCT GTAACTTAACTATTAAGGCCTTTTCCACA CGCATTAATAGTCCCATTTTTCTCTTGCC ATTTGTAGCTTTGCCCATTGTCTTATTGG CACATGG | 1.71E-05 | 0.007415852 | 3.23E-06 |
| 2079 | 2882128 | 9 | SPARC | ATGGAGCATTGCACCACCCGCTTTTTCG AGACCTGTGACCTGGACAATGACAAGTA CATCGCCCTGGATGAGTGGGCCGGCTGC TTCGGCATCAAGCAG | 1.47E-05 | 0.00652917 | 2.77E-06 |
| 1643 | 2882142 | 9 | SPARC | ATCTGTGGGAGCTAATCCTGTCCAGGTG GAAGTAGGAGAATTTGATGATGGTGCAG A | 3.85E-06 | 0.012687273 | 1.48E-05 |
| 518 | 2884192 | 4 | EBF1 | ACTGAGCCGCTTCACTGGAGCACTAATC GATTTGCTGTCAAGGTGGCCTGCTGGGG TTTCAAGCCAGAGAGGAATTGAGAGGCG CTCTGGCCCAATTTCCATAATTGCTCACT GCCTTT | 0.000885779 | 0.011197582 | 6.32E-06 |
| 792 | 2885859 | 5 | ODZ2 | TTACGCCCTCCCAATTGCTACATAATCAT GACCTATTCCAAGTTTATTCAAGCAGCC AAGTCAGGATGTCTCCCCAGC | 0.002565937 | 0.007653162 | 8.95E-06 |
| 1554 | 2886153 | 9 | PANK3 | TGACAAGCTGGTCCGTGATATTTATGGA GG | 1.62E-05 | 0.008848725 | 5.11E-06 |
| 1353 | 2887118 | 9 | STK10 | CTGCGCCTGTCTACCTTCGAGAAGAGAA AGTCCCGCGAATATGAGCACGTCCGCCG CGACCTGGACCCCAACGAGGTGTGGGAG ATCGTGGGCGAGCTGGGCGACGGCGCCT TCGGCAAGGTTTACAAG | 0.000160023 | 0.008064688 | 4.64E-06 |
| 365 | 2887495 | 2 | STC2 | ACATCTGACTGCCTGACATGGACTCCTG CCCACTTGGGGGAAACCTTATACCCAGA GGAAAATACACACCTGGGGAGTACATTT GACAAATTTCCCTTAGGATTTCGTTATCT CACCTTGACCCTCAGCCAAGATTGGTAA AGCTGCGTCCTGGCGATTCCAGGAGACC CAGCTGGAAACCTGGCTTCTCCATGTGA GGGGATGGGAAAGGAAAGAAGAGAATG AAGACTACTTAGTAATTCCCATCAGGAA ATGCTGACCTTTTACATAAAATCAAGGA GACTGCTGAAAATCTCTAAGGGACAGGA TTTTCCAGATCCTAATTGGAAATTTAGCA ATAAGGAGGAGTCCAAGGGGACAAA TAAAGGCAGAGAAGAGACAGAACTA AAAATACGAGGAAGGAGAGTGAGGAT TTTTCATTAAAAGTCTCAGCAGTGGGTTTC TTGGGTTATTTAAAACATCACCTAAATA GGCCTTTTCTTCCTAATTGGCCATCAAAT TAAAGCCTATCCTTTCTCAAGCAGGAGC TGGTATTGTAGGGAGTGGCCGGGTATTC TGGGCTGGGCTCTTCTGGAGTAGGGGGT CAGCAAACATTGTCTGCAAAGGGCCAGA TACTGAATCCAGTACTTTCAGTTTGGCGA GCCGTGAGGTCTCTGTCGAAACTACTC | 0.000619177 | 0.018246493 | 2.35E-05 |
| 1188 | 2887512 | 4 | STC2 | TGACACGACCCGAACCGTGCGCCTCCTC TGCTCTACCGGCTCTTGGCTCACCGGCA | 0.039351871 | 0.008021546 | 4.68E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AGCTGCAAAGCAGAGCCAGGCGTGCAG GGCACGGGGCTGGCCCTTTTCCCAGCTC GGAAAGAGAAAGAAAATCTGCCTACAG CTCCTTCGCTCCACGACCCCTCCCCGAC TTTGGGGGGCCGTGTGAACGCGGCAGCG GCGGCGTGCGTGCGCTCACCGCACGAGC TGGAATGCACGAGTGCCCATTAGGGACG CC | | | |
| 546 | 2888080 | 1 | | ATGGTAACACGCTGGCTAGCCCTGCTGG GTCCATGCCTGGAGCTGGGGTGGGGCTT ATTCCCTTCCGGACCTCATGGGCTCGGA GAGGCAAGTGATGGGTCTCTGAATGAAA TCAGTGCTGGGTTCATGGACACGGAAGG GAGGGTTGTTGTTACTTCTGTTTTACTGG TGAAGAAAACACCCGTGTTCACTACTGT CCTATTGGCAGCGAATTTGAACACC | 4.89E-05 | 0.010112214 | 5.90E-06 |
| 1727 | 2888742 | 2 | F12 | TCCTTGGTGATTCCGCAGTGAGAGAGTG GCTGGGGCATGGAAGGCAAGATTGTGTC CCATTCCCCCAGTGCGGCCAGCTCCGCG CCAGGATGGCGCAGGA | 0.000183201 | 0.007635791 | 5.72E-06 |
| 1209 | 2889481 | 1 | | GCCTAATCGGATTGTAAGCTCGTCGAGG CCGCTGGTCTCTTGCTCTCGAGGACTCCA TCCCAGCATTGGCAGCCTCCGCCTCCCC ATGTCCCAAAAGAGGAAACTGGGCTGGA GAAAGTTTCGCAGCCCAAGGACGCGTGG CTGGAAGTGGCAGAACCCGGGCTTCCGA GGTTGGGCGAGTGGGGTCCTCCAAGGCC CTCAGCACGGGTCGGAGGGATTGGGACT GAACCCGCCATCCCCCTGGACCTTGGTG CCCTCCAAGCCCCGCGCTCGCGCCCTGT CCGTCGCCTCCCCCAGAGATGCTCTGCA GGGACGATGAGACCTTGGTGTTCCCCGG TTCTCTGTCCCCTGGCACCACCTGAACGA TTGACATC | 0.000292999 | 0.0077346 | 3.92E-06 |
| 227 | 2890130 | 5 | RUFY1 | GCCAGAGCTCAGTAACATCCACATCCCA GAGTACAGAGAGAAAGCCAGCCTGGGT CACAGTAGTCAGCGTCTCCAGGGCCAGG CTGCCAGGAGAGTGGGCTCCCTGCAGAC CAAGGTTTCAGGATGAGCAAGCAAGGTG AAAACACCAACTTGCCACACGCAAATGG CTCGACACAACCCTTA | 0.003458386 | 0.015862344 | 1.98E-05 |
| 1442 | 2890334 | 9 | TBC1D9B | TGCATGTTCCCACGCAGGGAGTATAGTG CGCGCCAGTTCCGGCAAATGTCCTCCCC GAAACGCTGCACCAAGCACAGGAGCTGT GCACAGACCACCCCTCAGTAACAGGCAC AGCAGGCGCGGGTGGAAGGGGTCATTA GGGTTCCCCTGAGTTCTAGCAGGAACAT TCCCCAGAGTTCTAGCAGGAACTATAGA ATTCGTTAGTCCTCAGACTGGTCTATAGC CCTCATCATTGTTCACGTCAAAACCAGC ATGTTGAGACTTGTATTCATTTGAAAAA AGGAATTGAGGGTTTGGCGGCCTTTATT TTAACCTGACCAAGTGAGGGAATGCTCA GGCCCTTTTGCTCTGGTGCCATAGGGCG GGGCTGGGCGGGCCAGGCAGGAGGTGT GGCATGGGAGACCTGCTCCCCAGGGCCT GGCCTGGGGCTGGCTGTACAGAAACACA GACTACATCTCAAGGACCCCAGGAGCTT GCAGTCCCAACAGCA | 0.01496327 | 0.007323032 | 1.43E-06 |
| 767 | 2891058 | 4 | GNB2L1 | CTGGGAGCTAAGCTTTCTCAGCCTCCAC GTAATGACATTTTGGTCTGAGTAACTCTG TTGTGGTGTGCAGTCCTGTACATTCCAGG ATGTTTAGCAGCATTTCCAGCTTCTACTA GATGTCAGTAGCAAACCATCCTTCC | 0.016586586 | 0.006763538 | 5.07E-06 |
| 1346 | 2891302 | 4 | DUSP22 | TGGCACCATCTCTGTGGTGAAGTCACAG GTGCAAGCCCACGTGGATGCAGACGTGC ACATGTGTGTGACGTTTCGGGTTT | 0.000958852 | 0.007004444 | 1.00E-06 |
| 1000 | 2893481 | 3 | RP1-80N2.2 | AGTAAATGACCATCGTGCGCCCATGGGA AGAGTGCTGCATCCACGGAGGACATGGG CCAACAGTGCTCTCAAATGGGTTTCATG | 0.049041286 | 0.007653208 | 3.62E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 957 | 2893660 | 4 | RREB1 | AAAGCATCTGTGACTCATCCCTGTTCAA GAATGTTTTCATTACGATTCAGCAGAAG CGATGTGCCAGGTCAGCAAATACAACTG CAAAACCGGGGCCTG CTGCAGCCCGCAGTGAACACATGTGCCC CGACCCAGCGCAGTCGGCTCTGCCCTGC GCTTGCCCGTGTGAAGGGCCAGGGTCCT TGGCTCTCAGAAGAGGGATATTCTT | 1.26E-05 | 0.010296887 | 6.32E-06 |
| 1217 | 2894668 | 2 | PAK1IP1 | AGAACCTCCTCATGTGGCATCTTTACTTA TTCTCTTCTTGGAAAATCCATGTGACCTC CCCGCGCTTAAAGTGTTTCCACGTTACA GGCGACTTAAAGGCAGCCCTGGAGCCTG ACGTATAATTCGAGCGCCGATGCAGA | 0.000323032 | 0.00766513 | 2.99E-06 |
| 147 | 2896936 | 9 | CAP2 | GGTCCTGTAGCATCCACAGTATCAGCGT TTTCTGTCCTCTC | 0.032161453 | 0.02300686 | 3.11E-05 |
| 1783 | 2898612 | 3 | GMNN | TGTAGAAAGCATGGGGCTAAAAGTATTT TGACATAATTTATCCAAATTTAGCCTGGC TATAATTTCTGTAAGCCTTGAGTTAGTCA GAGGATGAGTAACAATAGAGAACATTTT TAAAAAACTAATTACGGTTGAATATTAA GTCTGACCCAA | 0.01160212 | 0.01009499 | 9.29E-06 |
| 1595 | 2898626 | 2 | GMNN | TGCCGAAGTTTACCTCCACTAGTTCTTTG TAGCAGAGTACATAACTACATAATGCCA ACTCTGGAATCAAATTTCCTTGTTTGAAT CCTGGGACCCTATTGCATTAAAGTA | 6.42E-05 | 0.009780056 | 3.60E-06 |
| 1239 | 2899122 | 4 | HFE | GGTGGAAACACACTTCTGCCCCTATACT CTAGTGGCAGAGTGGAGGAGGTTGCAGG GCACGGAATCCCTGGTTGGAGTTTCA | 3.62E-05 | 0.007219004 | 2.43E-06 |
| 2043 | 2901929 | 2 | TUBB | TCTGGTGCCCATTCCATTTGTCCAGTTAA TACTTCCTCTTAAAAATCTCCAAGAAGCT GGGTCTCCAGATCCCATTTAGAACCAAC CAGGTGCTGAAAACACATGTAGATAATG GCCATCATCCTAAGCCCAAAGTAGAAAA TGGTAGAAGGTAGTGGGTAGAAGTCACT ATATAAGGAAGGGGATGGGATTTTCCAT TCTAAAAGTTTTGGAGAGGGAAATCCAG GCTATTAAAGTCACTAAATTTCTAAGTAT GTCCATTTCCCATCTCAGCTTCAAGGGA GGTGTCAGCAGTATTATCTCCACTTTCAA TCTCCCTCCAAGCTCTACTCTGGAGGAGT CTGTCCCACTCTGTCAAGTGGAATCCTTC CCTTTCCAACTCTACCTCCCTCACTCAGC TCCTTTCCCCTGATCAGAGAAAGGGATC AAGGGGGTTGGAGGGGGGAAAGAGAC CAGCCTTGGTCCCTAAGCCTCCAGAAAC GTCTTCTTAATCCCCACCTTTTCTTACTC CCAAAAAAGAATGAACACCCCTGACTCT GGAGT | 0.003390971 | 0.008049603 | 8.03E-06 |
| 1186 | 2902700 | 5 | VARS | CACCACCATGGGGTTGTCCTCAATGCCA CGGAACAGTCCCCGCTCCTTCAGCGCCA CCAGCACCGCTTTCCTGGCCTCAAACCT GGGCAGGCCCTGGGTAGGAATGAGGCCT CATCATGGCGATGCCCAGCCATCCCTCC ATCTCCCTGACCCGGGCACTCTTGCCTCA GGCAGCCTCACCAGGAAAGGCGGAGGC ACATTGATGAGGGCCCCCCGGGAGTCCA TGATGCTGATGGCCTCCAGCCCGTGCCG CTGCCCAACTTCATAGTCATTTTGGTCAT GTGCGGGGTGATCTTCACAGCACCTGG GTGTA | 0.000252847 | 0.00748735 | 2.36E-06 |
| 1007 | 2902874 | 3 | CFB; XXbac-BPG116M5.17 | AGGGCTTAGGGGACATCTACTGAGTGAC AAAGGCAATGGGGAGATGACAGTGGTG GGAGCAGCTGAAGTGACGCAGTCTATTC GTCC | 0.016243657 | 0.006650439 | 4.11E-06 |
| 936 | 2903195 | 9 | HLA-DRA | ATGTGATCATCCAGGCCGAGTTCTATCT GAATCCTGACCAATCAGGCGAGTTTATG TTTGACTTTGATGGTGATGAGATTTTCCA TGTGGATATGGCAAAGAAGGAGACGGTC TGGCGGCTTGAAGAATTTGGACGATTTG CCAGCTTTGAGGCTCAAGGTGCATTGGC | 0.000384143 | 0.013596025 | 1.40E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 216 | 2903200 | 9 | HLA-DRA | CAACATAGCTGTGGACAAAGCCAACCTG GAAATCATGACAAAGCGCTCCAACTATA CTCCGATCA CCCAGAGACTACAGAGAACGTGGTGTGT GCCCTGGGCCTGACTGTGGGTCTGGTGG GCATCATTATTGGGACCATCTTCATCATC AAGGGATTGCGCAAAAGCAATGCAGCA GAACGCAGGGGGCCT | 0.000226058 | 0.023137572 | 2.88E-05 |
| 1913 | 2903425 | 9 | HLA-DPB1 | TGATTCTGCCCGGAGTAAGACATTGACG GGAGCTGGGG | 0.019535405 | 0.007421118 | 6.20E-06 |
| 1810 | 2903456 | 3 | HLA-DPB2 | CCAGGGGCTTCATGCTGGGGCTCATCAT CTGTGGAGTGGACATCTTCACGCACAGA AGGAGGAA | 0.001140973 | 0.007189358 | 4.98E-06 |
| 1173 | 2903747 | 4 | SYNGAP1 | CCATTTCACCAGAGCGTCCTTAGGGGCT GGGGGTGGGTTTGTTAATGGGGTGGAGG CAATGATGGGTTGGAGGATCTTGGCTAT AGGGGCTGTGCTGACTGCAGCAGGTAGG TTGGGTTTCCCTCTTCCTTCCCTAATCTT GGTTCTCTACCCTCCTTTCCACTCCTCAC CTGATTCTCTCTCTTCCTCCTCCTTATATC TGTGAGGCAGAAGGCATCTGAAGCTCAT ATTAGCCCCCATTGGGTGGGAATTAGGA GTGGGTAGTTAACTCAGGGAGACTTGAG ATACCCTGGAAAAAATGCTATTGAGATG TCCTGACATTAGGCAGGGTGGATGGAAC AAGAAGGAGCAAGAAAGGAACCTCAGG CAGATGTTAGGACATGGACTTGATCATG TGGCCTGGGAGTTTAGAAATGGGGAGAG ACATCCTCCTAGATCAGATCGTGGGCTC AGTAGGCATGTTGATT | 0.006813471 | 0.006836913 | 3.73E-06 |
| 914 | 2904304 | 9 | UHRF1BP1 | GCAGTAGAGTCCCTACAGGCCAAGAAAC TGAGCAGAACCCAAGCCTCCAGCTCACC AGCTGCATTGAAGCCCCCAGCTGGCAGG GAGACTGCTGTGAATGGACAGGGTGAGC TCATCCCCTTGAAGAACATTGAGGGAGA ATTGTCAAGTGCTATTCACATGACCAAG GATGCCACCAAGGAGGCTCTACATGCCA CCATGGACCTCACCAAGGAAGCTGTGTC CCTGACTAAGGATGCCTTCAGTTTGGGC AGAGATCGAATGACCTCC | 0.009512851 | 0.008610073 | 5.37E-06 |
| 1311 | 2905788 | 2 | ZFAND3 | TGGCCACCACGTGACGCTGTTCTTAGTTC ACTAATGTTAGCCTTATTTAGGACAAAG TCAGCCAGACACCTTGTACTGGGCACGC GTCAGACTGCAGCCAGTCCGTTTCCTTTC TTTAGCCAGCCATCCTGGTACTGTAGTTT AGGGGTTGATGGTGGTTGAAATTGATTT CTGGCTGGTTACTAAGGTGCCTGCTAGC CATTGTATAAA | 0.000250234 | 0.009189307 | 1.18E-05 |
| 1522 | 2906151 | 1 | | ATGGGAACAGAGATCCAATATTGTGTGA CTACAAGGAAGGAGTCGAACTGAGTGTC CC | 0.027602711 | 0.006514376 | 3.25E-06 |
| 753 | 2907867 | 4 | TTBK1 | GCCCGGGTAGAAAAGCATGCACTGAGCC CCCTGCCCCTAGACTGCGAGTACTGTAC AAATCCAACACTTGAAACCGACACGCAC ACGCGCGG | 2.23E-05 | 0.010219124 | 7.77E-06 |
| 1617 | 2909086 | 5 | RCAN2 | AGCAGCCAACTTGGACCCGCAAGTGGGA CCAAGTATGGAGCATGGCAGGGCTTGCT TCCAGGATCCCTGAATGACACTGTGGGG CAAAGCTACCGACCCTCCATGGA | 0.000200907 | 0.007185162 | 2.21E-06 |
| 424 | 2909642 | 1 | | TGTGCAAGTCCGAATAGAGCTGGGTTTT GGACTGGTCCAGGGGGAAAAGGCTGTTG GCCAGGCTGTGCTGGATCTTGGCCAGGT TGTGGCTGGAGCGACCAGGCGCTCCCAG TCACCTTCGGACTGGAAGCGGTTTA | 0.016461142 | 0.010554498 | 4.48E-06 |
| 292 | 2909752 | 1 | | TGGGACTCACATGAGGCCTATTACCCCT TTCTTCTGGCCTATTCCTCCCTTTTGGAA TGGGAATGTCTGCACCACCACTGTATCTT GGAAGTAAATAACTTCTTTTTTTATTTTA CAGGTTCACAGTTGTAAGGAACTTGCCT TGAGTCTCAAATGAGACTTTAGACTTTTG | 0.022567667 | 0.011174444 | 1.02E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AGTTGATGCTGGAACAAGTTAAGACTTT GGGGGATGGAATAATTGTATTTTGCAAT GCAAGAAAGACATGAGATTTGTTTTTCA TGCCACCAAATCTTATGTTGAAATTTGAT GCCCAATATTGGAGGTGGGGCCAGATGG GAGAAATTTGGGAACAGATCCCCCATGA ATGGCTTGGTGACATTCTCCCAGGAGTA AATAAGTTCTC | | | |
| 967 | 2910038 | 1 | | AGCTCCAGCAGGACTACCAAGGGCTGCC ACTGGCTGTCTGACAGTGCCTGG | 0.000792576 | 0.007667081 | 3.42E-06 |
| 720 | 2916447 | 6 | | ACAGCTCGGTTGTAGTGCACAATTAAAA TCACACTAACTTCATCTGAAGTGTCATTC TACAGTTTTATTTACACAACCAGTGAAG GGCATGTTCTAGAATACCAGCTTTAATC CTTTTCAAACATTAATATAAGAAGCCAA ATTGTAATGATACAGCAAAATGAGGCCA CTGGTATTAATACAGGTAGCAAAGGTCC ACATCCAGGTGGTACTGACATCAGGGAA ATTCCAAAACCAGTTGCTGCTGCCTAA GAGTGGTTGCCACTGACGAAAGCTTGAA | 1.19E-06 | 0.013525256 | 1.66E-05 |
| 1842 | 2918773 | 3 | RP11-1414.3 | TAAGGTCCCTCCAGTGTACAACAATTTG | 3.52E-05 | 0.008939061 | 7.01E-06 |
| 1845 | 2919791 | 4 | AIM1 | TCTGAATGCTGAAGTGACAGTTGGAGAT GG | 0.000116584 | 0.007440145 | 4.92E-06 |
| 650 | 2923986 | 2 | CLVS2 | ATGCCAGGGAGTGCCGCATTGCTTAGCG ACCCCGCCTCTGGG | 2.50E-05 | 0.014201609 | 9.88E-06 |
| 1180 | 2926824 | 9 | MYB | AGACAGTGCACCTGTTTCCTGTTTGGGA GAACACCACTCCACTCCATCTCTGCCAG CGGATCCTGGCTCCCTACCTGAAGAAAG CGCCTCGCCAGCAAGGTGCATGATCGTC CACCAGGGCACCA | 0.000449203 | 0.006598249 | 3.58E-06 |
| 1550 | 2927252 | 1 | | CTCTGTCTTGGGAGGCTATGAATTAAGT CAATGGGCTCCCTTCCTTTCTGTTTATCA GTTGGATTTGGTCAGTGGGGAGTCCAGG CAGGGATCTGCAGGAGGAAGGACATTG GGAGCTGGGTATTTCTCTCCTGGACTCAC TCTGTATGAGTCACTACAGGCTGGCTGT GTTCTTCAACAGAAGGTTATTGCTCTTCC CAAGGTGACAGCTCCTATGGGACTCACT TTCTAACAGGG | 3.56E-05 | 0.006844416 | 4.85E-06 |
| 1446 | 2929703 | 1 | | TGGGAAAAGGCTGTCCCTTTGCATCCCA AATAAGGCAATACGAAATTGTAACTGGA TGCTACCATGGACACCCAGATTCTATCC AGGAGAACATAAATAGAAGTGATGAGA ACACCCTCTCCCTGCTGGAAATACATGT GGGGTCC | 0.000272577 | 0.008755676 | 5.51E-06 |
| 229 | 2934526 | 4 | SLC22A3 | TTCCGGATTCGCTTATGGTCTCCAGGGTC AAAGGAAAGGGCGAACCAACGTTTGAA GGCAGCAGCAGCTTTTTTCCAGTTGCCC AAATGGTTACTCAAAATGCAAGGGGACA | 0.000205715 | 0.018234968 | 1.72E-05 |
| 1291 | 2934538 | 9 | SLC22A3 | TGACAGAAATAGTAGGTTCGAAACAAAG GAGGATTGTGGGAATCGTGATTCAAATG TTCTTTACCCTTGGAATCATAATTCTCCC TGGAATTGCCTACTTCATCCCCAACTGGC AAGGAATCCAGTTAGCCATCACGCTGC | 0.00362841 | 0.009917021 | 1.07E-05 |
| 1427 | 2934539 | 9 | SLC22A3 | CCCGTTGGCTGATTACTCGGAAGAAAGG AGATAAAGCATTACAGATCCTGAGACGC ATTGCTAAGTGCAATGGGAAATACCTCT CATCAAATTACTC | 0.001777336 | 0.007323945 | 3.98E-06 |
| 266 | 2934543 | 4 | SLC22A3 | AGGCTCTCTGAACATACAAACAGTATAA CTGTTGTTCACTAAATGGAAAAATCCCA AAATCAAAAACCAATGCAAAACAGTGA AGTGGCTTGAGCTCCTAGGAGGTTAGGT AGAAATTAAAGAGAATCAGTGGATGGGT AGAATTTTAAGCAGTAGGTAGTTACCCA ATGTAGAACGAGGATTAGCTTAGACACC TAGTCTGG | 6.72E-05 | 0.017329092 | 1.57E-05 |
| 1565 | 2934557 | 4 | SLC22A3 | AGAGTGTCGATACTAGGCAACAAGCCTC TGAACAGATAGTGTTACCCGGAACATCA CCCTTTTCTCCCTTTGCTTCAAATCAAAA | 0.000509079 | 0.00868456 | 8.95E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CCAGCATCCCCCATTTAGACAGCATAAA AGGTATG | | | |
| 180 | 2934569 | 4 | SLC22A3 | AGGGGCAGGTAAGTGAGAGTGTCAGTG AGCGGGCGCAGAGGGGACTCCC | 4.44E-05 | 0.022037658 | 2.59E-05 |
| 513 | 2934571 | 4 | SLC22A3 | TATACAGGGGCCGTGGTGCTACTCAGGG TTTGAGGAAGGGAGAGAACCTTTGAAGC TGTGGTAAGGGAGAGCTGGGGCATTGAT CTGGGATGCAGAGGTTGCTGTGGTTGAG AGCTACTCCAGTGAGCAACATGATGGCT TCAGAGTGAGCAGGCCCCATGGGAGAG GGCCCAGCTGTGTCTTCCTGGAGCGGTA ACACCTT | 0.000771692 | 0.013671209 | 1.16E-05 |
| 1174 | 2934586 | 4 | SLC22A3 | TGCTGGCTACAATTTGGAACTGTGCAGT TTAAATATTTATTTATTTTGTTTTGTTTTT ACTCTTTCTAATTTGGATATTAGGTTTTG CTTCATCTGTGTTTTTTTTCTCTTACTCAG TCAATAACCATATCTCCAAACTAAATTA ACGTTACTAAAGTGGGGAATTTCCCCTT CCTATATTCTCATAAGTGATTGAGCATCT GTCCTCATATAGGACTTGCTGCCTTGGA GGGGAGGGGCCAGACCTGGGAAAAAGA GGAGCCATGAATAACTCTGCTTCCTACA TTTGGCTTCTTCTCTTCCTCCATATCCAT GATTTATATATGTGAAGGAAGAACAAGA AATAACTTAATAGGCCATTTGTCAATGA GAGTACAGTGTAGGAAGGGTGGAAAGT GAATATAAAATCTAGATTGGGGCTTCTG GTTTCCTGTTCAGCCTATAAGGAGCTTAG AATTTGCCACTCAGTCTTGACAACAAGT AAAATGCTGAACAAACTGAAAAATCAAT AATTCTTCTCAGATCCATAAGAGAAGTG AGATTACAGGGCAAACTACTACCTTCAG CATCACCCCGCACCCCCAACCCCACTAA ATAGAAAGACAGGAGAATACAGAGAAT CATAACACAGGCGCAGAAACCTCCTTGA GAGAGCCAGGGTAGATAAACATGAACT GTAATTGATGAATTCCTGGAGGATCACT GTGGATGACCTGAAGGATTAAAAACTCT AGAGGGACTCACTCAAAGGAGGGCCCA AGCTTTTGTGATTTTTTTTTTTTTTTTTTT TTTTTTTGCCACCTGAAGCTCTACAAGGT TCCAAAGGTGAATATTAAGGAAAATCCC TCATGCTCTGGCAGCCAGAGGGGAAAAG GAACAATTTTGAAATATGCCAGAATATC GTTCTTAACAATGTCTGCCCTCAGGAGA AGATGTTTAACCAGAGCCTAATCTTCTG GGGTTTTCTGAGAGCCTCATTGATCTGG GGGAAGGGAAATACCAACTCCAGCCCCT TCTAGCCTTCCAAGTGGAGAAAGAGAAA CACCAAATTCTAGCCTCCTCTAGCTTTCA ACTTGGAAGAAGGGAAATACCCAGCTCC AGCCCCCTCTAGCCTTTCTCCCCTAGTTC AGAGGAGAGGGATAGAGAAGCATTTGT GAAGTTCACCGTTTAGAGACATAGGTTC | 0.02563769 | 0.010772341 | 8.50E-06 |
| 990 | 2934942 | 8 | AGPAT4 | ATGGGTTTGCTTTGATCGGACCAACCGG ATTCCTGAGTGT | 0.000540412 | 0.00716353 | 4.90E-06 |
| 787 | 2935707 | 1 | | GGCAGCCGGAGGAAACCTCACTCCCCAG ACTCTGCAGGAAACTTACGTGCAAGTCT TTT | 5.15E-05 | 0.011241051 | 7.14E-06 |
| 584 | 2936726 | 3 | RP11-568A7.2 | TGAAGAAAATAATGTGGGTAGCCGGGC TTCATCTTAGCAACACGAGCACCTCATTT TGGTTTTC | 0.02244372 | 0.011771471 | 1.03E-05 |
| 1366 | 2937410 | 4 | XXyac-YX65C7_A.2 | ACGCTTCGTTGGTCTCGGGAATACAGCT CCACACGCAAAAAAGTAAAAAGTGCAG CAAAACAACAACACAACGATCAACCTCA AAGGAAACAACAAAATTAATTTTATCAA AATGCAATGTGTACATTAAGACTAAAGT TATGGATTGTTCCTGTTTGGCATAGAAAT GTGATGACTATTAACAGAAAGGGGAAA AAGATTTGCCCCCTATCCATCATCAGAC | 1.83E-05 | 0.014910823 | 1.15E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 925 | 2937411 | 4 | XXyac-YX65C7_A.2 | AGACAGACTTCTCTTACTAAACCCCTTATGTGGAGTGGGATGAGTGACTATTTCCTGCAGAATGGCTTATGCACAGTATTCCCTTCAACTCCATATACACATAAATACAATAAGTAATTACATTTTATATGTAAACGTCATTCTTTTTAAACAAACAAGAAAAAGCAATGTAATGGCATGCCCAATTTTCACTCCACATAAAGTCTCATATATCACCAAACTGGTTTCCTCTAGTGGGTTAGATGTTCATCTCTGAGTTCCATTGATATTTATCCTCTGAAGGCACTTGGGTTTGGGGTTGCTGGCAGGAGGTGAAGAACCATCAGAGTTAAGGTCAAGGGACAGGAGGTGCTGCTAGAGAGAAGCCACAAGGACCACAATGAACTGAGGTGTCTAGGGACCATGGCATGCACAGGGCATTG | 3.03E-05 | 0.017161552 | 9.44E-06 |
| 895 | 2937484 | 5 | WDR27 | GCAGGCCAACAACGATGTCTGCGTGCCCCAGAGTCTGATAGGCAGCAGCCCGAGCCAG | 0.039759255 | 0.008047812 | 5.15E-06 |
| 741 | 2938547 | 7 | FOXF2 | TCAGATTGGGGAACGCTACCTTGCCAGCGGTTGTCCTTCTTCCAGCAGTAGGCAAATAACAGTGACCAACGCGATCCTGGGCATTCTG | 0.000412342 | 0.008173684 | 5.12E-06 |
| 381 | 2938741 | 9 | GMDS | TTGACCTCGCTGAGTACACTGCGGACGTTGACGGAGTTGGCACTCTACGACTTCTAGATGCAGTTAAGACTTGTGGCCTTATCAACTCTGTGAAGTTCTACCAAGCCTCAA | 0.014877417 | 0.008255843 | 7.22E-06 |
| 412 | 2941607 | 7 | TMEM14C | CAAGTAGCAGCATGCGCCCTGCATTCAGCGGGTGGAGAGTGGGGCGGGGCATCGCGGCGAGCTCCTGAGTCCAGGGAACGCGGCGGGGAATCTCTGTGCTTCCC | 0.000933891 | 0.019147592 | 1.94E-05 |
| 672 | 2941759 | 6 | | GGGAACGATGGCCTCCCAATAGATAGGAAACACCTGAAGCTGGTGATCAGCCACTTCCTGATAAGATCTCAGGAGTTGGGTGCGCAGGCTCAAGCATGCACCCTAAGAGGCAAAATAGTGGCATTTAACTCATATATGACCTTCCTTTAGGAAGGCTTGACTGGTAAGGGAAAAACTCCTCCAGTGAACACGTGCACAACTTCAGTAAAAACACTGCACATGCGTCCCCTCCCAAGTGCTGGCAGGCCACTGTGCATGCAGACAGCCCGCCCCAAAGAAAAATCAGAGGAGGAGAAATGGAAACCCCGGAACAATGCCAATGTATAAAACCCCAAGTCAAGGGCCTACCAAGGCAATTGGATCTCTCAAGTCACCCGCTTGGCTCTCTTCAAGTGCACTTTGCTTCCTTTTGTTCTTGCTCTAAAAACTTTTACTCCTGCTATAAAACTTGCCTTGGACTATCATGCTACCTTACGCCTCCCCGGCCAAATTCCCTCCTCTCCTCCGGGGGGCAAGGATGGAGTCTGCTGCAGACCCATTGGATTTGCTG | 0.000378341 | 0.00855831 | 5.95E-06 |
| 174 | 2941893 | 2 | NEDD9 | CCACTCACATCCGACGTGTGTGGTTGCTCAGTAGGGAAATGCTTACAGCTGCCTCTAGAAGCAAGTCCGCTCGCTGCATGGAG | 0.006757381 | 0.017550027 | 2.12E-05 |
| 1631 | 2943773 | 5 | CAP2 | ATGGCGCTTCTGGCCCTCAATCAGCCAGGG | 0.023624431 | 0.006508257 | 4.92E-06 |
| 1179 | 2944071 | 2 | DEK | CAGCGGCAGTGTGTCCATCATATTAAAAATATACAAGCTACAGTTGTCCGATCACTGAATTGGAACTTTTCTCCTGCATGTGTATATATGTCAAATTGTCAGCATGACAAAAGTGACAGATGTTATTTTTGTATTTTTAAAAAACAATTGGTTGTATATAAAGTTTTTTTATTTCTTTTGTGCAGATCACTTTTTAAACTCACATAGGTAGGTATCTTTATAGTTGTAGACTATGGAATGTCAGTGTTCAGCCAAACAGTATGATGGAACAGTGAAAGTCAATTCAGTGATGGCAACACTGAAGGAACAGTTACCCTGCTTTGCCTCGAAAGTGTCATCAATTTGTAATTTTAGTATTAACTCTGTAAAAGTGTCTGTAGGTACGTTTTATATTTATAT | 1.41E-06 | 0.012319789 | 1.03E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AAGGACAGACCAAAAATCAACCTATCAA AGCTTCAAAAACTTTGGGAAAGGGTGGG ATTAAGTACAAGCACATTTGGCTTACAG TAAATGAACTGATTTTTATTAACTGCTTT TGCCCATATAAAATGCTGATATTTACTG GAAACCTAGCCAGCTTCACGATTATGAC TAAAGTACCAGATTATAATGCCAGAATA TAATGTGCAGGCAATCGTGGATGTCTCT GACAAA | | | |
| 246 | 2945999 | 5 | LRRC16A | AAATGGCAAAAGAATCACATAAGGCAG AAAT | 2.93E-05 | 0.01735269 | 1.41E-05 |
| 1712 | 2948594 | 7 | TUBB | GTATACACCACTCCAGAGTCAGGGGTGT TCATTCTTTTTTGGGAGTAAGAAAAGGT GGGGATTAAGAAGACGTTTCTGGAGGCT TAGGGACCAAGGCTGGTCTCTTTCCCCC CTCCCAACCCCCTTGATCCCTTTCTCTGA TCAGGGGAAAGGAGCTGAGTGAGGGAG GTAGAGTTGGAAAGGGAAGGATTCCACT TGACAGAGTGGGACAGACTCCTCCAGAG TAGAGCTTGGAGGGAGATTGAAAGTGGA GATAATACTGCTGACACCTCCCTTGAAG CTGAGATGGGAAATGGACATACTTAGAA ATTTAGTGACTTTAATAGCCTGGATTTCC CTCTCCAAAACTTTTAGAATGGAAAATC CCATCCCCTTCCTTATATAGTGACTTCTA CCCACTACCTTCTACCATTTTCTACTTTG GGCTTAGGATGATGGCCATTATCTACAT GTGTTTTCAGCACCTGGTTGGTTCTAAAT GGGATCTGGAGACCCAGCTTCTTGGAGA TTTTTAAGAGGAAGTATTAACTGGACAA ATGGAA | 0.002029355 | 0.013237004 | 7.19E-06 |
| 537 | 2949541 | 3 | EHMT2 | ATTGTTATTGGGTTGTCGCTGCTTCTAGG ACTTTTGAGTGGGCAGACTTAGGAAATT TTTGTTCGTTTTTTCTTTTAAGAGACAGG GTCTTGCTATGTCACCCAGGCTGAAGTA CAGTAGCAGTTCACAGACAGTCATAGCT CTCTGCAGCCTCGAAATCCTGGGCTCAA GCAACCCTCCCATCTCAGTCACATGAGT AGCTGGGACTACAGGCATGCACCTCCAT GACCAGCTCCTGGCTGTATTTTTTGGAAA GAGAACAATTACTTTATTTTCTCTCTGGC ATCAGATGGTAGACGCTACTAGTCCCAT TTTTG | 0.033900726 | 0.007162816 | 5.30E-06 |
| 1358 | 2949792 | 4 | PRRT1 | GGCTGATGCCAGCCCGGGCGTGCCCCTC AACAC | 3.41E-05 | 0.010959106 | 4.97E-06 |
| 954 | 2950359 | 3 | HLA-DPA2 | CGAGGTAAGCGTCTTTCCCAAGGAGCCT GTGGATCTGGGCCAGCCCAACACCCTCG TCTGCCATGTTGACAAGTTCTTCCCACCA GTGCTGAACATCACGTGGCTGCGCAATG GGGAGCCAGTCATTGAGGGTATTGCAGA GACCATCTTCCTGCCCAGCAAGAAACTC AGATTACACAGGTTCCACTATCTGACCC TCGTTC | 0.0264846 | 0.006794213 | 5.43E-06 |
| 1074 | 2950628 | 1 | | AGGGTACTCCACCAGCGAGGATACACCG AGCCGACGGGGATCTCGGTCTCGGCGCC GGAAGCCTCTGAGAGCCGAATCTGGAAC CGGATGTGGCTGCTTCCTGCCCCGCCCCC TGCCGAGGGGGCGGGAATCGAGGGCCCT TCGGAAAACCCGGCCGGGATTTCGGTCA GCTACATTC | 0.002531721 | 0.007373825 | 5.32E-06 |
| 1957 | 2951240 | 9 | C6orf106 | GAGATTGCAGATGTCAGCGTCCAGATGT GCAGCCCCAGCAGAGCAGGAATGTATCA GGGACAGTGGCGGATGTGCACTGCT | 0.000742232 | 0.006740159 | 2.55E-06 |
| 1705 | 2951657 | 2 | FKBP5 | GGCATGTCCTCTTAGACCTGCTCTATGGT TTTTCTCTTACTCAGACTCCTTGGGTGAG GGTTGGAGTATTGTGGGAGAGACAAC TCGGCAGTGAGATGTACGCGCTGCTTGG GCTGGGTAAATCCTAGTAACATGGTCT TAACACTGTTGGTCAGGCATTGAATTTA | 0.01612054 | 0.006552065 | 5.39E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1150 | 2952044 | 4 | CPNE5 | ACTTTCTACAATGTGGAGGAGGCTGGTGTTGGGGGGCCATGGCCCCTGAGAGCCCCCAATGAAGCCCTTAAGTGGGACAGCAGTGC | 0.000292246 | 0.007034962 | 1.80E-06 |
| 270 | 2952341 | 9 | MDGA1 | TGTGGCTATACCCAGGACCTGACAGACAACTTTGACTGGACGCGGCAGAATGCCCTCACCCA | 0.029384212 | 0.01770572 | 1.92E-05 |
| 437 | 2952713 | 5 | DNAH8 | TGTTTGTTGTTTGGTTATGATCTTGCTT | 0.000896506 | 0.012004253 | 1.16E-05 |
| 1280 | 2954808 | 3 | GTPBP2 | GATTGGGTCTGTACAGTGTATGGTAACTGCTCACTGTTT | 0.008619147 | 0.009128367 | 6.34E-06 |
| 1607 | 2956143 | 5 | GPR115 | TACCATCATATATCACGCATTTCCCCCTCCTGGAATATGTGCAAAAACAAGCCTTTCTTCAACAGGAAAATGGTGCTGGTGTAGGACATCTACTCACGGCATCCAGGAAGTAGATCTAGCAGCCCAGA | 0.004167745 | 0.007592338 | 4.65E-06 |
| 1918 | 2965266 | 1 |  | ATGGCACAGATCAACCCAGTGTCCATTCCATGGAAGCATTCAGAGACTGAGGCTCCTCAGTCCTACCACAGAAACACTGAGAGTTACAGAATGGCAAATATCTGTAACTGGTTCCAAGCAAGAG | 7.04E-05 | 0.006704181 | 4.77E-06 |
| 89 | 2965642 | 1 |  | GGATTATGCCGGTTTCTACTGTGTCATGCAGGTTGTCAGGGAAGTGAGGGAAAGCCAGGAGTCACAGATCTCACCCAGCTTCCATGCAATCCAAAGGGCCGTTCTCACTCCCAATGTGCCCCGGACCCAACAGCACTGAGTCGTTTCCAGGCAGTGGGTAAGCAGGGCTGAGAACTTTCCCCAGGCAATCTGCTTCCCAGCTGTGAAAGCAAATATGGCTTTCCTTCTTCCCCCACCTGTGGAGACTGCACACCGGATTCACGCCCTTCCCTGAGTTCTGGCCAGGAGTGTTCTCAATCAGCTCAAATTGTTACAAAGTTCAGCTGGAGGTTTTCTTCTCCTGTGGCTTTTCCCGGCATCTCTGGTCGCCCTCCTGAAG | 2.62E-05 | 0.025473063 | 1.96E-05 |
| 1267 | 2968105 | 4 | SEC63 | GGGTCAGCAGCGTTTCCCTCGGCGCTTCTCC | 0.002641545 | 0.00762644 | 6.71E-06 |
| 1406 | 2969569 | 1 |  | ATGTGCAAATATCACCACTAATTCCAGAATATTTAATCACCTCAAAAAGAACCCCCCTGACACACACACCCAGTAGCAGTCCATGCCCCACTTCC | 7.50E-05 | 0.009287234 | 7.32E-06 |
| 1046 | 2970405 | 1 |  | CTCTCCAGTCTATTGAGCCCCTGCCCCCACACCCTATCGGGTTCAGAGCAGAGCT | 1.39E-06 | 0.012220589 | 9.68E-06 |
| 1903 | 2974773 | 1 |  | TTGCCTTAGAGGGAAATGATGCCTTGTACATATCTCATCCCACAGTGCTGCTGAATGCGTCCATTTCAGGCAATGCCCAATTTGGAGAAAAGAAGAAGTGCAAAAAAAGATGTTTCTTTGACCTCACCGCAAATA | 0.000450333 | 0.006875027 | 2.38E-06 |
| 869 | 2976265 | 1 |  | ATGTTCTGGTTCCTAGAGAGCAAGACATGGTGCACAGACCTGTGGGTGAAACCCGATGGAGACCCATGG | 0.000148906 | 0.008014361 | 2.11E-06 |
| 1216 | 2980527 | 9 | CNKSR3 | GTCAGCTGGTTTACGCGCCTCAAACTGTTGA | 0.006618995 | 0.010696705 | 8.84E-06 |
| 779 | 2980896 | 4 | NOX3 | GGTGGCAGTTCTGCCGCTGCCACTGCCTGTGCCTAAGACTTCTCCCGTGGTCCCTCAGCTGGTGGACAGAAACATTCTCCACGGAAGAAGTGCC | 0.044188955 | 0.0069985 | 8.86E-06 |
| 763 | 2982371 | 4 | SOD2 | CTGAGCTGTTGGAGGACTTATTACCATTCCCTGGAGAAGAAGGAAAGTCATCTTCGGTTGTGTTGCCCTCCCTGTGAAATCCAGACCCAGACGTCCTCTGGCGGGAGGAGCTACCATTACTTGGTCCGTTTGTCAGACGACTGCAGTCTTTACTTGTGGCCTCTGACTGTTCTACAGGTTCAGAAGCTGTAGTCCTGCTGGTACTTG | 0.000562297 | 0.007631489 | 4.53E-06 |
| 1154 | 2982612 | 5 | SLC22A3 | CAGAAGATTAGGCTCTGGTTAAACATCTTCTCCTGAGGGCAGACATTGTTAAGAACGATATTCTGGCATATTTCAAAATTGTTCCTTTTCCCCTCTGGCTGCCAGAGCATGAGGGATTTCCTTAATATTCACCTTTGGAACCTTGTAGAGCTT | 0.00199727 | 0.007947392 | 5.12E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1299 | 2982619 | 5 | SLC22A3 | GTGGTACGGACCCTTTCCATGATCCCCA AAAGTTTCCTTGTGTCTCAGTGAAGTCA GTCCCCTCCCCCCACTCTGGGCTCTGGAA ACCCAGATCTGCTTTCTGTCATGACAGTT TTGCTTTTTCTAGAATTTCATAGAAACAG AATCAACAGTGTCTCACTTGGCGTCCCG TTTTGTCATACCTTTTATGCTGTCTAAAT GGGGGATGCTGGTTTTGATTTGAAGCAA AGGGAGAAAGGGTGATGTTCCGGGTA ACACTATCTGTTCAGAGGCTTGTTGCCTA GTATCGACACTCTCTATTCATGGGAAAA | 0.000394997 | 0.009799409 | 9.65E-06 |
| 598 | 2982626 | 5 | SLC22A3 | GAGGTCTATAAACAGTCGCACTGGGAGA GTCTGCCTTATGCGGTTGAGATAAGGAC TGAAATACACCCTGGCCTCCTGCAGTAC CCTCAGGCTTACTAGGATTGGGAAACCC CGCCCTGGTAAATTTGAGGTCAGACCAG TTCTCTGCTCTAGAACCCTGTTTTCTGTT GITTAAGATGTTTATCAAGACAATACAT GCACCGCTGAACATAGACCCTTTTCAGT CATTCTGCTTTTGCTCTTTGTCTTGTGAT GTTTGT | 0.008884278 | 0.009911085 | 7.59E-06 |
| 1038 | 2983744 | 1 | | CCTGCAGCTGCATAAGTAGTGTTTCATTG CACCCCAGCAGGAGCTGGTACCGGTTCT TCCCTTGCCTCATGCTGGGGTAGATTTTA TTTAGGATTGGGAGCAGGGAAAGGAGCT AGAGAAAGGAAGGGTTCCAGGAAGCTG GGAAGGGAGATGTCAGGTGGGGTGATG GGAAAGGAGGCCAAGGACCACCTTTGCC TGTATGGTGGGCTGAACTGTGTCCCCAC AAAAGATAGGGCGTCCTAACCCCAGATA CCTGTGAATGTGACCTTATTTGGGAATA GAGTTTTTGCAAATGGAATCAAGTCATG ATGACGTCATTAGCATGAGCCTTAATTT AATAGGATTGATGTCCTTCTAAGAAGAG AAGACAGGGACACACAGGAGAAAGCCA TGTGATGAAGCAGGCAGGAGCTGGAGC GACACTACCACAGGCCAAGGAACATTGG GACCAGAAGAGGCGAGGAGGGGCCGTT CCCTAGAGGCTTTGGAGAGAGCATGGCT CATCAACACCTTGACTTCAGACTGGTAG CCCCCAAACGGTGACAGAATAATTGTCT ATTGTTTTAAGCCCCCTGGCTTATAGTAC GTTGTAAAGGCAGCCCTAGGAAGCCCTA AGCCAGTTTCACTCATTATGATAAATATC ATAGATGATGACTGTCATATATTGGATG TGCTGGAGATCTTCACAGCCACAGAATA AACTGCAGGCCAAAAAAAGAACATTCAT ATGAGGTCCCCAGCAGGGGCTGGCTGTG CAAGTCAGAGACTGCAGAACCAGGTAG GCAGACAAAGCGAAATTGCCTGGAGCTG GACACATATGTGCACCACTGGGAAATAA ATAGACTTGCGGTGGAAATGACCAACGT GGATGGCCAGGGAAATGCCAGCAGCAA TAAAAGAAAAGAGTGCACAAGGCCTGT AAATCAGCAGATGCGAGAGCTCCCGAAA AGTAGCGAAGTCTGAAATAAAAGGCAG GCTCAGGCTGGTGGTCCAAGAAGTTAAA GCAGGAAATGAGAGCGTGGGCACTGTGT GTGCTGGGCTCCCAAAGACTGCAGGGAG TGGCCAGATGTCTCCAGAGGCAGCGTCA TGTGGAGCAAAGGGGACCTGAGGAGTGT CAGCATCCTCAGTCACCTCCTCCTTTGAA CCAGCTGTTCGGAATCTGGTCTCTTACTT AGGATAATTGTAGGAACTGACTTTTTTTT TTTTCTTTTCTCACCTATTGGCTGACTG AAAGAACCGACTTTTAAATGAGCACCTC CCTCATTAGAATTGCTCAAATGACAACA GCTGCAGCGGTGGGAGCAGCAGCAAGTT TGAAAATCAACAGTCTGCATTCCACAG TGACAGTATTCTTGGTCACCTCGGAGAC | 0.025498894 | 0.008506019 | 9.12E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1545 | 2985812 | 2 | THBS2 | ATGGCAGCCGGGAGCCACGGCTCTCATT GCTCGGGGTTGGTTGGGTTACCAGCCCT AGGGCTACAGAATGTATCTAAAAGAGAG GCTTGGCTGGCAGTTTAAGAGGGGTGCA GGACAGCAGGATGGGGTTCATGAGGCA AGAGTGGATGGAGCCTGTGGCCCAGTTG GGATGAGATGGGACAGTTCCAATGGGCA GGACAAACCCCAGCCACCGTCTCAGGGT ATTTGACAGGAGGTAAACAGCAGACAA AATCCTGGAGCACAGGGGGGCAGGGCT GTCTCGTTCCCATGAATGGCA CATCCTTGCAAATGGGTGTGACGCGGTT CCAGATGTGGATTTGGCAAAACCTCATT TAAGTAAAAGGTTAGCAGAGCAAAGTGC GGTGCTTTAGCTGCTGCTTGTGCCGCTGT GGCGTCGGGGAGGCTCCTGCCTGAGCTT CCTTCCCCAGCTTTGCTGCCTGAGAGGA ACCAGAGCAGACGCACAGGCGGAAAA GGCGCATCTAACGCGTATCTAGGCTTTG GTAACTGCGGACAAGTTGCTTTTACCTG | 9.90E-05 | 0.012219435 | 9.02E-06 |
| 173 | 2985814 | 2 | THBS2 | TCCTGTCCCTTGACCTTAACTCTGATGGT TCTTCAC | 7.38E-07 | 0.023947968 | 2.18E-05 |
| 1365 | 2985815 | 2 | THBS2 | ATGCCATGGTCCCTAGACACCTCAGTTC ATTGTGG | 4.36E-06 | 0.0130199 | 8.34E-06 |
| 257 | 2985821 | 9 | THBS2 | ACCGACGTGGACAATGACCTTGTTGGGG ACCAGTGTGACAACAACGAGGACATAG ATGACGACGGCCACCAGAACAACCAGG ACAACTGCCCCTACATCTCCAACGCCAA CCAGGCTGACCATGACAGAGACGGCCAG GGCGACGCCTGTGACCCTGATGATGACA ACGATGGCGTCCCCGATGACAGGGACAA CTGCCGGCTTGTGTGTTCAACC | 5.55E-05 | 0.019474651 | 1.88E-05 |
| 912 | 2985825 | 9 | THBS2 | TTCAATCCCCGCCAGGCTGACTATGACA AGGATGAGGTTGGGGACCGCTGTGACAA CTGCCCTTACGTGCACAACCCTGCCCAG ATCGACACAGACAACAATGGAGAGGGT GACGCCTGCTCCGTGGACATTGATGG | 0.000212296 | 0.009058079 | 5.43E-06 |
| 55 | 2985827 | 9 | THBS2 | ACAAGGACGGGATTGGCGATGCCTGTGA TGAT | 2.10E-08 | 0.04925015 | 6.11E-05 |
| 1672 | 2985830 | 9 | THBS2 | TGAGCCCGAAAACCCATGCAAGGACAA GACACACAACTGCCACAAGCACGCGGA GTGCATCTACCTGGGCCACTTCAGCGAC CCCATGTACAAGTGCGAGTGCCAGACAG GCTACGCGGGCGACGGGCTCATCTGCGG GGAGGACTCGGACCTGGACGGCTGGCCC AACCTCAATCTG | 0.00060261 | 0.008283886 | 6.83E-06 |
| 1900 | 2985852 | 4 | THBS2 | GACCCTCACTGTGCCTGTTACCTGAGGG GTGATTTGCAGCACAGGCAGAGTTATCT TGGCTCCAGCACTCTGCGTGCCAGGGCC TCAGCTTCATGAGGCAGTGCTCTTCTGG GGGTTCCTGGGGTGCAGTTGGCTGTGGG GCTTTTGGGTACTTTTTGTTGCAATAATG TTTTTTCAGTCTGATATATTTATATGTAT ACGTGTGTGTGTGTGTGTGCGTGCGT GTGTATTTTCACTAATATAGAAAAATATT GTTTTTATAAACAAAACATATATGCAAA TATTCTTTGTATGAAAGAAAATATACCCT TCGCGGTGTTCCTAATCACATGTTTGTAC TATAATTTCACGTGGGTTCAGTTAAACTA GAGCTAAGGTTGTCCATGGCATGTTGAG TCAGTTGTCATAATGGTCAGTGAGTAAA ACTAACCTACTATGACAAACGTGACTTA CACCTCTATGTGAGCAAACACCTTGTGT GTGTGTGTGTGTGTGTGTGTGTTACCA GCATACACCCTAGTAGG | 1.07E-05 | 0.006706587 | 7.05E-07 |
| 1263 | 2986383 | 4 | DLL1 | GAGATTTCCGTATCCGGCCTCTGTGCCA GGTCTCCAGTCAGAGGCGCCCCTTCACG TGGGAAGGTTCTGGTTTCCCGACTCCTA GACGCGTTGGTGGCGCGATTACCCGCGC AGCGCGACCGCTACCACCCGGAGCGTGC | 0.00076237 | 0.006667557 | 2.62E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1041 | 2986512 | 4 | PSMB1 | CCATCCCCCAAGAAAAATGACAAGGGCC CTCGGGCCTCTTCCACCCCATCCTGCCTG CATTCTCTCTCTCTCTAATTAAAAAAA CAACGTAATATCCTGTAGTACAGGCTGA AAAAACACGTCAGGAAACCACTCTTTAA AAAGTTCTTCCATTTCCTTAGGGAAGGT GAGAGCAGGCAGGAGGTGCGTGGAGAC CCTCTCCAGACACGCTGCCCCAGACCTG CAGCCTTCAGGCCTCTGTTGCTGACCTGG CTGTTAGGAATGACTGCTTTTTGCCGTTT TCTTTTCGTTACCTTTCTGGGTTGTCTAA CGTCTTCTCC TACCAGTGGGTAATGTAGGGCTCGCAAA GGTATAGTAAAGCTAGGATTTGCAGTCA CTGTATTGTCATGCTAAGACCCTGTTTTG GATGCTTGTGTTCTACTGTAGATGTTT TAAGGATCACGACCACTGCTGTGTATTA AAATCATGCAGAGTAAGGGTGCTGCCCT GTGTCTTCTGTTCTCACAGAGATCTGCTC CACAAAGAGAGGGACTTACATCTAGGTT TGATCAGGGATTGCCGTAATTTTTCTGTA AAGGACCAGATAGTAAATATTTACAGCT TTATGGGCCTCATTTGATCTGCTTCTGTA GTGAAAAAGCAGCCACGGACAATATTCA TAGCAATAGGGAGTAGGCTGGATTTGGC CCCTGAGCCAAACTACAGGGGTAGTTTG TTGACCCCTGGTCTATATGCAGAGTGAG GGAGAGAGATGGATTTAAACCCATCTTC CTTAGGCCACTTCATGTGCCCTTTCATAC ACATTAGCTCTTGGATTAGCAGTACCTG AGATAAGGGTGGTATGGAAAATAGAGTC TAAACCAGAGAGCTGAGGGCAAACTTGG CATTCCTTCCCTTA | 0.012305161 | 0.007787863 | 2.74E-06 |
| 1517 | 2987970 | 6 |  | AGTGAGCACACCCAGGCCGACGGCTACC CAGATGTATCCAGTGGGTACACCCACGC CCACGGCTACCCGGATGTATCCAGTGGG TACACCTTGGCCCACAG | 0.000701725 | 0.008122069 | 6.02E-06 |
| 1160 | 2988685 | 5 | FBXL18 | GATCCTCCTATAGTTCCTCAATGTGATGA CTGGGTGTTCACACTCATTGGCGAGATG TGCCTCTCTCAAACCTTGTTCAGATGCTG CAGA | 2.14E-06 | 0.013965334 | 9.39E-06 |
| 301 | 2988989 | 9 | USP42 | TCAGTTAATAGGTCCTCAGTGATCCCAG AACATCCTAAGAAACAAAAAATTACAAT CAGTATTCACAACAAGTTGCCTGTTCGC CAGTGTCAGTCTCAACCTAACCTTCATA GTAATTCTTTGGAGAACCCTACCAAGCC CGTTCCCTCTTCTACCATTACCAATTCTG CAGTACAGTCTACCTCGAACG | 5.20E-06 | 0.018386695 | 1.25E-05 |
| 1278 | 2989490 | 5 | COL28A1 | TGAATCATGGTGCTCCTACTAAATTCCA GGTGTCCC | 0.003684101 | 0.006751514 | 1.06E-06 |
| 1425 | 2989606 | 4 | AC006465.3; GLCCI1 | AGAGAGTAATAGCATGCGCACCCTAAAG TTCACATTCCTTTTTCAGCAATCACTGGA TAATCCCTGGCTCCTGACATTTTCTCCAT ACAGAGTAGAGGTTCATGATCACTTTTT CATAATACTTTTAGGTAATTTTAATATACT GAGGGATAGTGACTTAGGATTTGCTCAC TTCGTATAAGATAAAACCAATGATGGGC ACACATTTACCTGTGTAACAAACCTGCA CGTCCTGCACATCTATCCTGGACTTTAA GTTAAAAAAAACCAGTGAACACCCAAC TAGACATATTCCTGAATG | 0.024995647 | 0.00697113 | 4.25E-06 |
| 893 | 2990835 | 5 | AGMO | TAAGAAGAAACAGTAATACCAGCAGCA GCATATTGGTGGCTGGATACA | 0.000106893 | 0.008642024 | 4.81E-06 |
| 1859 | 2993333 | 7 | CYCS | TGCGGCCTCCGCGACCCGCTCTCACCTCT TTTTAGTCGCTGGCACAACGAACACTCC CGCTCCGAAGCCGGA | 1.63E-05 | 0.009327163 | 5.44E-06 |
| 558 | 2993375 | 1 |  | TGTGTCCAAGAAAGTGTGGCTAGTAAAA TAGACTTTGGAGATGGGCCGAAGTATCC ACTGATTGAAGAAAACAGACAAGTCCAA GGAGGAAATGCATACAAGGCAGAGGTG | 0.000920533 | 0.009480199 | 2.07E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GTAGGCAAAGAGGAGTATAAGATTGAC AAGGA | | | |
| 465 | 2993385 | 1 | | GATTTGGTTGTTAGGGATGGAATCAAAC AAGACACGGGATTTGAGCTGATCTT | 0.000496534 | 0.011230659 | 7.84E-06 |
| 1709 | 2994249 | 1 | | CTCACTCGGTAAAAGCCAGGTCCTGACA CGGGCATTCGTGGTCCCACACGAGAGCC TGCCTGCTGCTTCTTCAATCACACCTCTT ACCACCCATGGCCCCTTGCTCACTCCACT CGAAACCCGGAGGTCTCCTTTCTGTTTCT GCCTCAGGACCTTTGCACTGGCTGTCTTC CAACCTGAAAGGTTGCTTTTGCCCTTGGT TCCTCCAGGTCTTGACTCAAATGTCATCT TACCAGTAAAGTCTTTTCACCTTGGCAGT TTTTATCCCTCTTTCTTGCTCAGTTTTGT TTTATATTACATTGCACTTAACACCATTC CATACTTAATACCAAACAACGTCTTCTTT GTTTATTATCTGTCTCCCCCTAAAATGTA AGTTCCATGAGATTTTTTTTTTCATTGC TATATCCAAAATGCCTAGAGTTGTTACT GGAACATAGTAGGTGGTCTGTACACATG AACC | 0.000611594 | 0.008053291 | 5.10E-06 |
| 1065 | 2994656 | 4 | CREB5 | CTATGGCAGGTATACCAGGCCCAGAGCA ATGAGCGAGAGAGGTGGTCA | 2.98E-05 | 0.00904156 | 8.03E-06 |
| 1001 | 2995111 | 7 | SCRN1 | CATTTCGGGATGTTTGGAGTCAATCAGA TAAAGCACATTATGACAGAAACCATAAG AGGGGAGCTGGGACCTGGGACTGTGCAG AATGAAAAGCCACGGCTACGGGAAGCA TAAGCTTGTGCTGCAACGGCATGTGCAC ATGACCTGCTGCTCCTGGCCCTCTACGA AGCATGCCCAGCAAGGGAACCTCCTCCG TCCCTCCTCCACGTGCTTCCTTCCTAAGG CTGAGAGCTCAACTGAAGACCTTCCCCA ATAAATGACAGATGGCTCTTCAGTCAGG AATGCAGTTAGTGGTTTCATGACAGACA CACTGGTCCCACCCGGCTTCCCTGCTGA ACCACCCAGTACTGAATAACACCTGTAC CAATGTGGGATGACA | 0.000242546 | 0.006895394 | 4.13E-06 |
| 1026 | 2995377 | 1 | | CAGGCCCAAGTTCGCCCAGAGGTGACAC ACTTGGGAATTTGTGGTGCCATCGTGCC AGGTCCCTCCTCGTAAAAGTGCCTACCC AGCGCCTGCAACCAGAGCCAAAGCCTGG ACATGATAGGGAAACTCTTGTTAAAACG CGACACGTGGTCCTG | 4.39E-05 | 0.00926322 | 5.50E-06 |
| 1782 | 2995444 | 9 | GARS | ATCTTGCCATTTGTGATGAGTGCTACATT ACAGAAATGGA | 5.76E-05 | 0.011995848 | 8.82E-06 |
| 404 | 2997012 | 1 | | GGACTTGCTTCTCAAGGTGGGACTTTGCT GCACGCTGTACAAATTGGTTGCTTCTG | 0.000118492 | 0.012317168 | 6.55E-06 |
| 370 | 2997133 | 4 | SEPT7 | AAGTTGTCTTCTCTAGGTTTCTGCATTCT CCTTATTAATTCTTGAGCTTCTTAATTTC TAGGATGTGTTTTCTCCCTGTGTCCTTCC CTAATCTTACACCTGTTGCTCCTCAATTT GTGTGTATGCACATGTACATGTAAGGAT TTTTCTGATGAATGTTCAGGGAGCAGTG CTGTACTTAGTTTTACCTTACTTTTGCCA GATTCTACTAAAAATTTTACGTGAGTTTA GCCCTGTTTATTCAACTAAATAAGATACT TGGGAATTTATATCTAAAGGAAGAATCT CAGTCATTGTAAATAAATGACCTAAAGT CATTATTGTGGAAATCAATCAGAGAAAT CCCTTTCTGGAGTTTTACATCCTTTTTGG AACTCTTTTGGTATGACAGCTA | 7.71E-05 | 0.010482923 | 5.22E-06 |
| 444 | 2997175 | 6 | | GGATTCTTGGACCATCCAGAGGACAAGG GGCGGCCCCTCTTCAAAGATCTCTCA | 0.009101689 | 0.013517476 | 1.49E-05 |
| 1450 | 2997383 | 4 | ANLN | GCCACTGAGTTTGGGTGGTGTCTCCGGT ACCAGCAAGGCAATGGAAGGCACACTG CCCATGCTTGACATTTAATGAACCCTTTT CACTCTCTATTTGCTGAACCAACTCTCTA AAGTTTAGGTTGTTAATCTCCAGAAGTG GTGGAATTAAACACAAGCACACACACAC ATACACACAAACAAAAACTCACCTGTAG | 0.023754148 | 0.009205054 | 7.66E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | TCTTACTCTTTCCTCAATCCTAGGATTGA TTCCCAGCCAGCATCAGACAGCCTCCTT AGTCTTTTCCTGGAGTGTA | | | |
| 79 | 2997407 | 9 | ANLN | GCTATTACTCCAAAGCGACTCCTCACAT CTATAACCACA | 1.29E-05 | 0.027389498 | 2.57E-05 |
| 628 | 2997645 | 5 | ELMO1 | TACGGAGGGGCATTCCTGCTAATCCAGA ATCTGCATGTCAGGACATTCTGGAAGCA TTTTGCTTTGCACTAAAGTCAACCTCAAA AATTAATATCCCACAATCACATATAGCA GAAACGCAGAGCAAAGAGTT | 0.021002867 | 0.009159887 | 6.97E-06 |
| 1779 | 2998743 | 4 | C7orf10 | AATACTATGGGAGTTGGCAGCTAGAAAC ACAAGTTAGGAAAGG | 0.00011347 | 0.007120881 | 5.41E-06 |
| 2070 | 2998957 | 7 | AC005027.3; INHBA | GGCGTTGCTGAATACTGTCCACTAACTG TACAAAATATTGACTGCATGCCTCGCAA ACACCAAAATATCCGCTGGAATGCCATA GAAATAAATAACTTCTGCTATAAACACA TGAA | 6.01E-05 | 0.006964308 | 2.98E-06 |
| 718 | 2999112 | 5 | GLI3 | CCAGGGTGAACACTGTGGTGCACTCCGG GATGTTCGGCTGCAAATAGAGAAGACAG GGCAGCAGCTAGAGAAGACCCAAGGCC AGAAGTGCTGTGTGGATGTTTTGACTCT GTTTGTTTATGGGTGGAAGGCACTGGAG CCACCGAAGTGGAGGAAGAATGAAGTG AGAAAGGAGAGTACCGATGGAGTCAGG GTCCCTAGAATCCAGAAT | 0.001466913 | 0.009358662 | 6.89E-06 |
| 2058 | 3000529 | 7 | IGFBP3 | GGTGAATCTCTATGTGCTCCCAGTGTCCT GGATGGGCTCCCCAGCAAGCCATTCCTC CTTCCTGTTCTGATATTACTATTCTTTTTT ACATTGTGCTAAGGAGGACAAAAGATGA GAGATGAAAATAAAGCTTTGCCTTTAAA GAGCTTATCCTCAGAAATAAGCTTCGTC TTGAGTTGTTGAACTACAAAACACTATTT TCTGCAGTCATCCGAAGAATTGTGCCAT TACTTGTGATGCCTCTGAATGTGGAGGC TGACTCTCCCTGTCTCTCTGTCCCTCCTA CCCCACGGGGCCGCAGCAAAAGCCATCC TGGGCCTTCGACTGGGCCATGTCTTCAG GAAGATTCCTGAAGAGGAGGGCCCGAA ATACCTGCCTTTATAGGTTCCCAGAGTGC CCTAGAACATTCTTAGATACATATTTTTT AAACAAGTAGGACTCCACCTTATTTTCTC CAATAGTCCCCAAGCAGTACAGGTCACT TGAAGACATAAACATTCTTCTTGGTTGA GGGATCCACGCCCTTGTTTCAGAAATGA CACCACAGAAGGCTGTGAGCTCCAGGAG CATGCGTTGGGATGTCCGGATGACCGGG GTTTAAAGGTTTTCCTATTCTCGATAAAG CCTGTGCGCACTGTACGGGGAGTGGGGG TGAAGCGTGTTCTCTACATAGGCAACAC AGCCGCCTAAGTCACAAAGTCAGTGGTC GGCCGCTTCGACCAACATGTGGTGAGCA TTCCACGGGCGCATGAAGTCTGGGTGCT GTGCTCGAGTCTCTGAATA | 0.000391017 | 0.006979675 | 2.90E-06 |
| 823 | 3006506 | 1 | | TCTGACTGAGTGTATTGAATGGCCTTCTA CGGTACTAGTCATGTGTCAGACCAGACA CCTGATCTCAGTGGATATGCCTCCTCAG GC | 1.22E-05 | 0.009439851 | 9.16E-06 |
| 1980 | 3010073 | 5 | TMEM60 | ATATGAGGAACCAGTTCCAAGGTGCTTT CTCA | 0.00041969 | 0.006577928 | 3.02E-06 |
| 991 | 3010612 | 5 | SEMA3C | CCAGGTTTATTTCTAGAGGCCCATGGGT ATTTACACTTTTCCTTGTGTGTTGTTGAG TATACCAAAACAGAACTGCCAGCCATTA GCCCATGGCTTTTCTGCCTACGTGAAAA CAGCAGGATTATAGTACAAAGGGCAGA GACCTAAGCCAAGATTATGTGCTAAGAA GAACGGTAAGAGCATAAGCCCGCTGAAT TACTGGCACCTTATGATCCTGGAACTGA GAGCCCTGACAGGGTTTGATCCACTATT TTGGTTCTTTCTGCTCTACCTCTGCCCAT CCCTCCTAATGCAGATAAAATTCATTCAT | 0.001082945 | 0.009528208 | 6.30E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 446 | 3011436 | 9 | RUNDC3B | TCTTTCACTTTCAAGTATTTGCAGTCACG CATCCCTTAACAATG GACAAGAGTTAACTGCCCATCTCACCAA CCAGTGGCCTTCTCCAGGAGCTCTGGAT GTCAATGCTGTTGCCTTGGATACGTTGCT TTACCGAAAACACAATAAACAGTGGTAT G | 5.65E-05 | 0.009499059 | 7.55E-06 |
| 1463 | 3012549 | 9 | ANKIB1 | TTCCGTAAAGCACTCATCAATGGTGATG AAAACCTGGCCTGCCAAATATATGAAAA CAATCCTCAGCTAAAAGAATCTCTTGAT CCAAATACATCTTATGGGGAGCCCTACC AGCACAATACTC | 0.000586459 | 0.008029494 | 2.20E-06 |
| 548 | 3013157 | 9 | COL1A2 | TTGCATACATGGATGAGGAGACTGGCAA CCTG | 1.66E-06 | 0.017474811 | 1.42E-05 |
| 1418 | 3013369 | 4 | PPP1R9A | CAATCCTAAACATATTTGGGAGCTGCAC ACCTAAAAGAGGAGCTCCC | 4.61E-05 | 0.009215595 | 3.64E-06 |
| 1622 | 3013678 | 4 | DYNC1I1 | ATTGGACTTCAAGGAGAAATTAAGGAGG GTGGTCGAATGTAGATCAAATTAA | 0.029646817 | 0.006940481 | 2.98E-06 |
| 1796 | 3014762 | 2 | BUD31 | TGGACTCTGGACTTCGCAGGTTCCTGCCT GTCACGCCACCCCCTTCCTGGGAGCAGC GAGCAGTGCCCCAGGCCCGAGTTGGAGC ACGGTCTCTATGG | 0.000120755 | 0.007722082 | 4.42E-06 |
| 1626 | 3015101 | 6 |  | GGCATCCCAGTCTTCGGTCTCCAAATCC ACCTCCTGTCTGTCCCCCCACACTGCTCC TCAGGCCTTGTGGATCCATTGACTGTGAT TTCTGTGGTTCAGCTCCCACATCAGGCA GGAAGGGCAGCTACTGGGTCTGAGATCC CACATTGCCTCCAACCCTTGCTTCCTAGC TGGCCTCCCAGGGCACCACGAGGGGCTG GGCCAGGCTGCTGTGCTGCACGTGGCAG GAGTAGGGGGCTGTGTCCTGCGGGGGCA CTGCCACCACCACCCAGGACTGGTAAGT GCCATTTCCATTGTGAAGAACATCTCCCC GTAACTCAGGCTCCTGCACCTCGCCGGC CCGAGTCCAGTGCACATCAATTTTCCCTG GGTAGA | 0.002212029 | 0.00893252 | 8.09E-06 |
| 1793 | 3015540 | 2 | PILRA | GGGCCAGCTTTGATAATGGAGCGAGATG CC | 3.04E-05 | 0.006597037 | 4.97E-06 |
| 497 | 3017037 | 4 | LRRC17 | GAATGTAAGGGCCAGAAAGCTTGAATGC CCAGAA | 0.000200907 | 0.013948871 | 7.99E-06 |
| 1269 | 3017439 | 4 | LHFPL3 | GAAATGTAACATGGGCAACTCCGAGCCC ATGACATGTTACAAGGACAAAT | 0.011739756 | 0.006799509 | 2.22E-06 |
| 1890 | 3017590 | 9 | MLL5 | CGTTTGGCAACATATTGACTGCATGGGG ATTGATAGGCAGCATATTCCTGATACAT ATCTATGTGAACGTTGTCAGCCTA | 0.000333103 | 0.008691028 | 6.56E-06 |
| 585 | 3017615 | 9 | MLL5 | TTGGGAAGCCAGTAGTTTGGGCTTAGTG ACAGCTGCTCTGCATATGGTAATTGTTGC TGCCTTTACATGGGCT | 0.004464194 | 0.007736726 | 6.92E-06 |
| 1218 | 3018430 | 9 | HBP1 | GTGATCCTACCCAATCTGGCATGTACCA GCTGAGTTCAGATGTTTCACATCAAGAA TACCCAAGATCATCTTGGAACCAAAATA CCTCAGACATACCAGAAACTACTTACCG TGAAAATGAGGTGGACTGGCTAACAGAA TTGGCAAATATCGCGACCAGTCCA | 0.005019305 | 0.006977198 | 6.61E-06 |
| 900 | 3020009 | 4 | MDFIC | AGAGTCCTGTTATACCGCCACTGGGCAG GTGATAGTCGTAGCAGCTAAAGAATGGG GAACAACTGGGGGTGCTCTGTGGCGTTG ATGTTAAAGCTACAGAGTCAGGTTTGAC CTCAAAGCAATTTCCTAAATTACTAAAT ACACATAACTCTTATTGTTCATGCTTTAA TCCATGGTCTTTGGCATATTATTGGCCTG TTAAATGCTAATAAACCTTTGTTTCTCAG CATGTAGTTTACATGATGGGGACTTGAT TAAGAAAGTACTTTCAAGCATCTTATTTC ATAGGAAACTTTATTAGAGATAAGATAA GACCCATTCAAATATGCATTCTCTTAAA AATGGGTTGTGAGTTATTCTCAGAATTCT CTGCTGTCTGTCCTTTCCTGTACTCCACT TTA | 3.41E-05 | 0.013179927 | 1.10E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 209 | 3022789 | 7 | IMPDH1 | GTGAAGCCTGGGAGACCTCCTGACATGG GGCCCACCTGCACCAGCACACCCCCACC CCACCCCCAGTACCTCAACACCCTCAAA CCTTCCTGGGGAGGCAGGGCCTGGTGCC ATACCCCCAGCCCAACTCTGATGGGGC TCCAGCCACCCAATGGACAGGGCATACA GACAGGATAGTGGAGGCGTTGAGACCTG CTTGATTATTCCAAGTATTTAATACACA ATGACGCAACTGTGATCCCAAGTGTGCA AAGTTAAAGCCTTCGACTGCAGCTGAGG AGAAGGGAGGAATGGTTCACCTGGGGA CGGTGGTGAGTCAGGAATGACAGGCAG GCGGCCATGACCAGGGCAGTCTCCTACC CATG | 0.037823788 | 0.01275585 | 1.46E-05 |
| 1057 | 3023361 | 9 | SMO | TGCCGTATACATGCCCAAGTGTGAGAAT GACCGGGTGGAGCTGCCCAGCCGTACCC TCTGCCAGGCCACCCGAGGGCCCCTGTGC CATCGTGGAGAGGGAGCGGGGCTGGCCT GACTTCCTGCGCTGCACTCCTGACCGCTT CCCTGAAGGCTGCACG | 0.000729678 | 0.007489073 | 4.24E-06 |
| 1196 | 3023750 | 4 | KLHDC10 | GCAGTTCGTAACTCCTGACTTTATGAAAT GTCTGAGAAGCCAGGTTCAATGTCCCAT ATTCCTCATTAATAATTTATAACACTATA ATGTGATTTCGCCCTGTGGGTGGATAGG CTTTTTACTAGGGTAATAACAGTATGGT GATTCCAAATTATTTGGGTCCTGAGTTTG AATTCAGCTTGTCAGGTGAGTTTTAGCTT TAATTTCCTAACTTGCAAAATGGGATTA ATAATATCTTAGAGGGTTCAATATAAAG TATCACGCAGTAGAAGGTCAACAAATGG GGCTTATGACGATGACAGTTA | 9.02E-05 | 0.009325147 | 9.03E-06 |
| 1696 | 3024264 | 8 | AC058791.2 | TCAGTCTGCCATACAGCAATTTTTAAATG ACATAATCCTTTAGAAATCAAGCAGTGA TCAGTGCTCAACTTGAAAAGTGATGGGG GTGGGGGGAACAGGCAAAAAAAAAAAA AATCACAGAACTTTAGAAGATACTGTCT ATCCCAACGGCTCTCAAAGTTTGGCCCT CTGACCAGCAACGTCAGCATTACCTGGA AACTTGTAAGAAATATACATTAGTGGGC CCACCCTAGACCTT | 0.000454879 | 0.006967013 | 4.72E-06 |
| 1829 | 3024911 | 5 | CHCHD3 | TTAGAGTGCCTGTGAGATACTAGGCACT GTGGGACAAGACCAAGAGACTGAGTCA GGCAGACCTATCTAGCCCATTAAGAACT GCTTTAAAGGGACACATCTGGCAACAGT AAAA | 0.01615124 | 0.006700971 | 3.74E-06 |
| 1726 | 3027105 | 4 | CLEC2L | GAACAAGTGGATAAACGGTAACTGACTT CACCCCATCTGAGAAAGTCCAGAGAGCA GAGGAGTTACCTGAGCCTCATGG | 2.22E-05 | 0.007139137 | 3.31E-06 |
| 1885 | 3027444 | 1 | | TCCTGAGCTCACAGGTTTCTCCCACCTCA GCCTCCCAAAGTGCTGGGATTACAGGCA TGAGCCACCATGCCTGGCACAATTTCTTT CTAGAACCCAAATCATCTGCCAGATCAG AAGTCATTTT | 0.008028233 | 0.006511512 | 4.30E-06 |
| 487 | 3027586 | 5 | BRAF | CTCAAGGGTGAAGAATGAGTCTTACCTG ACACATTAGATAATGAACAAGCTCAA GTCTTAAAATCCTGATTTATTTTAAACTA GTGCTTAGACATGACTGTGGTTCAAGTTT GGCAGACAGGTTTAAATGTCAAATCCAA CACTAGAGACAATACCATTTATTTCAGTT AAGGAATATAGACTTTGCCACCAAATAA TTACATATTTTTCATTCCTGTATGACATG GATGCCTCTATTTGCATGACCTCTGAGTA TGAAGTAATAATATATTAATTTTCAACA ACTGATCTGTCTGAAAAATACAAAGAAA CAGCAAAATGGTGATATTAAAACTGACT CACCCACTGTCCTCTGTTTGTTGGGCAGGA AGACTCTAACGATAGGTTTTTGTGGTGA CTTGGGGTTGCTCCGTGCCACATCTGTGG GA | 5.28E-06 | 0.01350394 | 8.95E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1485 | 3028591 | 1 | | TGTTCCCCTATCACCGATGCACAGACCCAGAAG | 0.000945161 | 0.007818806 | 4.35E-06 |
| 1153 | 3029904 | 2 | CNTNAP2 | CCCGGCGTTGCACTGGCACACAGTGCAAGAGGCAATACCCGCACGGAGGGAGAACGAAGGCTGAGACTCCCCTGCCGCTCCAAGCCCGGAAGAACTGGAGCCTGGAGGGGGGTGAGGGGAGAAGAGGAAGCGGGAGGGGCTTGGCTTCCTCGCGTATTTGAGGACAGCCCATCT | 0.006827559 | 0.006900031 | 5.28E-06 |
| 1529 | 3030862 | 1 | | GCAGAAGCAGTTCCCTAGGTCTAGGTCTCCAGGACCTGTCCACAGTCACTGAAACGCCTTCTAGAATTGATCTAGTGGAAAATCTAGATGCAGTTTAGGTCTTTGGCACTGTGCCCATCTCCTTTAAGAACTGTGCAGTGTGGCTTGGAAGAGGAAATGTGGTCCCTTTGATGGGAGAAACTGAAGGACCTTTTTGAACTCAAAGGAGCTCCAGGGTTTGGAATTGGGGGCAGAGAAGGCTCCAGGCTGCTCATTCCATCCTGGGTGAGCCGAACGGGTCCTGGCTGATCTGAGTGCGACCTTCCCAGTCTG | 4.47E-05 | 0.010863593 | 6.72E-06 |
| 747 | 3030882 | 3 | SSPO | GGCTTTGTGACAACCAGGACGACTGTGGCGATGGCTC | 0.001705241 | 0.008747664 | 3.19E-06 |
| 323 | 3031189 | 4 | ATP6V0E2 | AGGTGATTCTGACGTGCTGCCCGCCAGGCCTGCCCTGTTCGCTCCCTGGTGCATGGAGCCGG | 5.87E-06 | 0.015735604 | 8.36E-06 |
| 1310 | 3031580 | 3 | GIMAP5 | GTGATGAGTGTTGCGGGCATCAGCAGGTGCACAGCTGGTGGAGCACAGCCTGAAGAATCTGTGCCTGCACTCACAGCCCAGTCCCAGGACAGCGGGCTTTGCTGCCCCATTGCCCATTACTTAGCCAAGTCGATCTCCATGAAA | 0.003557945 | 0.007082989 | 2.22E-06 |
| 1452 | 3031668 | 9 | ABP1 | AAGCCCGTGCCGTCATCTTCTTTGGTGACCAGGAGCATCCCAATGTCACCGAGTTTGCTGTGGGGCCCCTGCCAGGGCCCTGCTACATGCGAGCACTGTCCCCCAGGCCTGGGTACCAGTCCTCCTGGGCATCGAGGCCCATCTCCACAGCAGAGTATGCCCTCCTCTACCACACCCTGCAGGAAGCCACCAAGCCCCTGCATCAGTTCTTCCTCAATACCACAGGCTTCTCATTCCAAGACTGCCATGACAGATGCCTGGCCTTCACCGATGTGGCCCCCCGGGGTGTGGCTTCTGGCCAGCGCCGCAGTTGGCTTATCATACAGCGCTATGTAGAAGGCTACTTTCTGCACCCCACTGGGCTGGAGCTCCTCGTGGATCATGGGAGCACAGATGCTGGGCACTGGGCCGTGGAGCAGGTGTGGTACAACGGGAAGTTCTATGGGAGCCCAGAGGAACTGGCTCGGAAGTATGCAGATGGAGAGGTGGACGTGGTGGTCCTGGAGGACCCGCTGCCTGGGGGCAAGGGGCATGACAGCACACAGAGGAGCCGCCCCTCTTCTCCTCCCACAAGCCCCGCGGGGACTTCCCCAGCCCCATCCATGTGAGCGGCCCCCGCTTGGTCCAGCCCCACGGCCCTCGCTTCAGGCTGGAGGGCAACGCTGTGCTCTACGGCGGCTGGAGCTTTGCCTTCCGGCTGCGCTCCTCCTCCGGGCTGCAGGTCCTGAACGTGCACTTCGGCGGAGAGCGCATTGCCTATGAGGTCAGCGTGCAAGAGGCAGTGGCGCTGTATGGAGGACACACACCTGCAGGCATGCAGACCAAGTACCTCGATGTCGGCTGGGGCCTGGGCAGCGTCACTCATGAGTTAGCCCCCGGCATCGACTGCCCGGAGACCGCCACCTTCCTGGACACTTTCCACTACTATGATGCCGATGACCCGGTCCATTATCCCCGAGCCCTCTGCCTCTTTGAAATGCCCACAGGGGTGCCCCTTCGGCGGCACTTTAATTCCAACTTTAAAGGTGGCTTCAACTTCTATGCGGGGCTGA | 0.002849134 | 0.00784346 | 4.34E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 764 | 3032568 | 1 | | TGCAGACACCAGATGCGAGACAATAGG AAGAGCTGACTGGGTGGTTCAGGACCTG CCACTGGGGACAGTTTCTTCGTCCACCTT TGGTCTTGGGTCCATGCTTCCATGTCCTT C | 0.001797859 | 0.006590099 | 2.66E-06 |
| 417 | 3033649 | 1 | | ATGCAGGAGCGACTGGACCCCACATCCT G | 3.28E-05 | 0.016185129 | 1.54E-05 |
| 1497 | 3034150 | 5 | PTPRN2 | CAATTCCCGCTCATACACAGCAGGCCAG AAAGACTTCCACGCTGCACACAACGCTC AGAGCAGAACGTCTGGGAATCAATCTAT CCAAATTTG | 0.001268815 | 0.006942742 | 3.14E-06 |
| 1400 | 3034165 | 5 | PTPRN2 | AGTCACTCTGGCATCGCCTGCAACAGCA AATAAATGAGTGGCAAACAAGCTCTCGC GGAGGGTATTTAAATATTTTATGTGACT AAGAAGAATGAGATACGTCCATTTGCTG TGATAAGAAAAGATATTCCACAGTTTCG TATTTGTTAAGTATTTTCAGCAAATCATG GAACACGATGCAACACCCGATTC | 0.000142286 | 0.007604817 | 5.46E-06 |
| 62 | 3034212 | 5 | PTPRN2 | CCAGAGCCACAGTATGCTGAGGGTCCAC GCATTACATCCTTCCATCTATCCACCACT AAACCACAGCCACAGTACACTGAGGGTC CATGCGTCACGTCCCTCTGT | 5.67E-06 | 0.041004965 | 4.35E-05 |
| 1509 | 3034226 | 5 | PTPRN2 | CCATGGGAACTCCACACCATGAGAACAG GGCTTCAGAGACCGCAGAAACTCCACAC CACGAGAACAGGGCTTCAGAGACCGCA GAAACTCCACACCACGAGAACAGGGCTT CAGAGACCAGAGTAACTCCACACCGTGA GAACAGG | 4.26E-05 | 0.009473058 | 6.04E-06 |
| 449 | 3034229 | 5 | PTPRN2 | AGCTCCTTTGTTCCTAAAATCAATGCCAC GTCCCCAGCTTACAACTCCTTGTTCCTAA ATCAACGCTGCGTCCCCAGCTTACAACT CCTTGTTCCTAAAATCAACGCCACGTCCC AGCTTACAACTCCTTGTTCTAAAATCAAC GCTGTGTCCACAGCTTCAACTCCTTGTT CCTAAAATCAACGCTGCATCCCCAGCTTA CAACTCCTTGTTCCTAAAATCAACGCCG CATCCCCAGCTTATAGCTC | 7.50E-05 | 0.01521519 | 1.17E-05 |
| 1769 | 3034583 | 6 | | ACAGTTGCAGGCACGCAGCGGTCTCCCA GCGTCAGGGCGCACCGCGA | 0.001374129 | 0.007171184 | 4.35E-06 |
| 1792 | 3034982 | 5 | SUN1; GET4 | ATGGTTCTACCATGAAGACACACGCACT CAAATGCCCACTGCAGCACCACTCACAA CAGCACCGACATGGAATCAAGCTGGGGC CTGTCAGCGGCAGACGGATAAAGAGGAT GTGGTCCATATACACCGCGGAATACTAT GCAGCCATAAAAAGGAACAAGATCATG CCCTTTGCAGGAACTTGGATGGAGCTGG AGGCCATTATCCTTCGCAAACTAATGCG GGGACAGAATCCCGGGCACTACACTTCC CCACTTACAAGTGGAAGCTGAATGATGA GAACACAGGGACAGAAAGGGGCCAACA ACACACACTGGGGCCGGCCTGAGGGAA GAGGGAGAGGCTCAGAAAAACCATTTTAA CAAAACTGTCAGGTACCCATGCTTGGTA CCCGGTGCTGAAATGATCTGTAGGACAA ACCCTAGTC | 0.003031295 | 0.008267621 | 3.22E-06 |
| 1925 | 3034996 | 4 | ADAP1; COX19 | CTGGATGTAGGGCCTGCCTCGGCGACCT GCCGGTCACGGGCCCTCTCTGAC | 0.001925692 | 0.007392579 | 3.91E-06 |
| 1260 | 3035770 | 3 | GRIFIN | CAGCTGGGACGCGGAGCACTTCACGTC TACGCCCGGAGCACAAGGTGCTACAGT TCCCATGCCGTCAGAGGCCGCTGGGCGC CACCACCAGGGTGCGCGTGCTGAGT | 0.000180795 | 0.007217638 | 2.93E-06 |
| 1115 | 3036697 | 5 | WIPI2 | ACTGCGTAAGGCAAGAACGTCTCTACTG TGACTTCACCTAGTCACTGTATCTCAGGG TGCAGCTACTGGCTGTCATCATGTCCACT CTACAGCCAGCAGCCTAATCAGCTTTCC CTGCAGGGAGTGCGGGCAGAATCAGATT GCCAGGGGTCTCCCGGGTGGTGCTGTTA CCCTGGGCGTGAGCACAAGCT | 0.000167867 | 0.00903808 | 4.79E-06 |
| 1516 | 3036972 | 6 | | GAAGCTACTATCATGGGCGTTTAGAGTT ATACAAATGACACTTACAAAAAATAAA | 9.88E-05 | 0.007741062 | 6.32E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GACCAAGACACCCAGAGTGAGATGCATG TTGGGGACGGGGGAGGCTGGCAGCAGG GGGGCCCCGGCGGCTCACCCCAGGGCTC CCGGAGGGGGCGACGCCTGGCTTCATCC ACCCGGGAGGCCCAGGGAGCACCAATC ACAGCAGGGGCTCTGGCCCAGGTGTCGG CAGCCCAGGCCCAGGGCTGGGGCTGGAC GGGAAGGACGGAAAGAGGGGGCTGAGA TGCACCCCCTGGGGAGGGTGCTGAGACG CCCCCCCGCCAGATCACTCGCTACTACAG CCAGGCTTGCCTGGGACGCCTCCAGCAA TAATATTTC | | | |
| 1683 | 3037200 | 9 | EIF2AK1 | GCTCTTTCAGCCGTTTGGAACAGAAATG GAGCGAGCAGAAGTTCTAACAGGTTTAA GAACTGGTCAGTTGCCGGAATCCCTCCG TAAAAGGTGTCCAGTGCAAGCCAAGTAT ATCCAGCACTTAACGAGAAGGAACTC | 2.49E-05 | 0.007813506 | 5.78E-06 |
| 1958 | 3037328 | 6 | | CAAAGTTCAGTGCTCGGTGTTCTCGGCA CAACAATGCAGTGTAGTTCAGAAGGTAT TTTGGCAACTCTTAATCTGAACAAGAAT GGGGGGGGCGCTTTTGAAAAATAAGGCT TTAAGAAGGCTTGTCATTTTAGGGCTAA ATTTTAATAGAATGTGAGTCTGAACTCTT ACATTTAGAACAAACAAAACCTTAAAAT TACTGATTGGTTCAAAAAATGGTTTTATG GAAAAATTAATCTGTAACAAAAAGTTGG CATTGAGTGCGAAGGCTCCACCGTTGTT TTTTTTTTTGTTTTTTTTTTTGTTTTTTT TTGAGCAAAGCGTACAAAGGTTCCAAGG GACAGGACCAAGAACGAGGGGCTGAGA CATTTACAACAGCAGGCATTTTCTCTTCC TCTTCTTCACGGGAGGCGGGCAGAGGAC TGCTCGGATCGCTTCGTCAAACACTG | 5.98E-06 | 0.008945527 | 7.37E-06 |
| 1464 | 3037738 | 1 | | GATAGGAGGTTAAAATGATCAAGGATAG TCAGGGACATGACAAAGGTGGCACATGT GCCTTTACAGATTTGGCACGAGTTTAAC CCTGAGTCTTTATTTGGAAAATGGTTTCC AGCTATAGGAGGATTTAAACCCCTCATT GTAGGTGTATTGCTAGTGATAGGAGCTT GCTTGCTGCTCCCCCGTGTATTACCCTCG CTTTTTCAAATGACAAAAGGTTTTGTTGC TACTTTGATTCATCAGAAAACTTCAGCA CAGGTGTATTATATAAATCACTATCGTTC AATCTCACAGAGAGACTCAAAAAGTAAA GATGAGAGCGAGAACTCCCACTAAAAGT GAAAATTCTCAAAGGAGGGAAATATGGT GTGAGACCACCACGTCTCCTGCTG | 0.006389661 | 0.007386167 | 4.59E-06 |
| 784 | 3039035 | 5 | SCIN | TTTCTCCCTCCTCGACAGCATCATGATCC TCCACCAGAGCATCATGATCCTCCACCG TATGTCCCTGCTCCGGCTCTACCCCTCTC CCCCACTCTCTCCAACCAACCCACTTCTG ACTCTGAGTCCTCTCTGCCTCCTCCCCTC ACCCGCTCTCGGGCCCAATGTGCTCAGC AACCAGCTCCCTTGCTTCCTCTCCGGGAA GTAGCGGGAGTTGAGGGGATCGTCCATG TCCACGTCCCTTTCTCCTTCTACGATCTC TTACAG | 7.97E-05 | 0.009191604 | 2.92E-06 |
| 1383 | 3039818 | 2 | AGR2 | GCTGACCTATTGCTGAGGACTATGAGAA AAAGTTATTACAGAATGAGTCATATGG AAAACACTTGCAAAC | 0.000128137 | 0.011486351 | 1.09E-05 |
| 629 | 3041213 | 4 | AC099759.1 | ATTGCTGGCAATTCCTGGTCATGCTGGTG CATTTCCTCTTGGAGTCAGACATGTGGGT TCTGTGATGATTCTCTGAGTCCAGGATTT ATCCAGCC | 0.004590062 | 0.011694926 | 8.46E-06 |
| 254 | 3042471 | 3 | HNRNPA2B1 | TCATTGCGGCGTGAACAATAATTTGACT AGAAGTTGATTCGGGTGTTTCCGGAAGG GGCCGAGTCAATCCGCCGAGTTGGGGCA CGGAAAACAAAAAGGGAAGGCTACTAA GATTTTTCTGGCGGGGGTTATCATTGGCG TAACTGCAGGGACCA | 0.003098917 | 0.012381991 | 9.24E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1118 | 3043075 | 7 | RP5-1103I5.1; AC004009.3 | AATCAGTGTTGCCTGGTGGATAGCAAATCAAGTTTCAAGGTTACAGA | 0.000701725 | 0.010817936 | 7.40E-06 |
| 1457 | 3043108 | 8 | RP5-1103I5.1; AC004009.3 | TGCTCAATCTTCGACTTCATACGCTTCATTTTTTCCTTACCTCCATCAACTAAATAACGCCCTCTTGCC | 0.013431886 | 0.008758105 | 6.86E-06 |
| 330 | 3044438 | 1 | | GTCAGGAGCCCTCTGTATAGACAAGGGTAGAGAGAAGCTCAGGAGGTCCTTAGCAGCACCCTGTGGGAGAGCAGGGAAGGCCACAGGAAACCTGACCCCTAAGACCTGGGTCCGGGACTCAAGAGAATGGAAATGGAGAGGAACCAAGAGGAAGCACAGACTGGTAGTGGGCACCCTGTCATTGGAGCTATGTGAGGCGATAAGGTTTGGCTGTGTCCCCACCCAAATCTCATCTTGAATTGTAGTTCCCATAATCCCCACGTGTCATGGGAGGGACCCGATGGGAGGTAATTGAATCGTGGGAGCGGTTTCCCCCATGCTATTCCTGTGATACTGAGTCAGTTCTCACAAGATCTGATGGTTTTATAAGGGGCTTTTTCCTTTTTGCTGGGCACTTCTTGCTGCCGCCATGGAAGAAGGATATGTTTGCTCCCCCTTCTGCCACGATTGTAAATTTCCTGAGGCCTTCCCGGCCCTGCCAAACTTGGTCAATT | 0.000224879 | 0.011215692 | 7.96E-06 |
| 1448 | 3044555 | 1 | | CCCATGAGTGGGGAGACTTAGTATTCAGCCCGTGCTTTCAGCATC | 0.032104854 | 0.006681803 | 7.10E-06 |
| 136 | 3044692 | 9 | PDE1C | CAGAACTGTCTGTGGAACTCCCTCATCGATGGGCTCACAGGGAATGTCAAGGAGAAGCCAAGGCCAACAATTGTCCATGACCCTCGACCCCCAGAGGAGATCCTAGCTGATGAATTGCCACA | 3.19E-05 | 0.020143883 | 1.83E-05 |
| 255 | 3046448 | 2 | SFRP4 | TGTTGTTGCAATGTTAGTGATGTTTTAA | 1.66E-06 | 0.023764559 | 2.43E-05 |
| 350 | 3046449 | 2 | SFRP4 | AAATAATGCTTGTTACAATTCGACCTAATATGTGCATTGTAAAATA | 6.33E-07 | 0.020534054 | 3.08E-05 |
| 868 | 3046453 | 9 | SFRP4 | CAGGAACAGCGGAGAACAGTTCAGGACAAGAAGAAAACAGCCGGGCGCACCAGTCGTAGTAATCCCCCCAAACCAAAGGGAAAGCCTCCTGCTCCCAAACCAGCCAGTCCCAAGAAGAACA | 8.12E-06 | 0.017228888 | 1.44E-05 |
| 630 | 3046457 | 9 | SFRP4 | TTAGTTGAAAAATGGAGAGATCAGCTTAGTAAAAGA | 4.28E-06 | 0.01509688 | 1.74E-05 |
| 49 | 3046459 | 9 | SFRP4 | GTCACAACGGTGGTGGATGTAAAAGAGATCTTCAAGTCCTCATCACCCATCCCTCGAACTCAAGTCCCGCTCATTACAAATTCTTCTTGCCAGTGTCCACACATCCTGCCCCATCAAGATGTTCTCATCATGTGTTACGAGTGGCGCTCA | 2.62E-09 | 0.069643156 | 0.000104049 |
| 1318 | 3047600 | 2 | AC005027.3; INHBA | GTGCCAATACCATGAAGAGGAGCTCAGACAGCTCTTACCACATGATACAAGAGCCGGCTGGTGGAAGAGT | 0.000729678 | 0.012639164 | 1.27E-05 |
| 943 | 3047613 | 4 | AC005027.3; INHBA | ATTAGGTGATGGTAGCGGACTAGCCGACGGAGGGCAGGCAGGGGAGGGGGAGAGGACTTTACAGAAAAGGAATTCTCGGTCGAGCTCTGCCTGGAGATGACTGGCTTACACTTACTAAACCCAGCGGGTCA | 0.000339114 | 0.011103507 | 3.96E-06 |
| 1475 | 3049299 | 9 | IGFBP3 | GTGTGGATAAGTATGGGCAGCCTCTCCCAGGCTACACCACCAAGGGGAAGGAGGACGTGCACTGCTACAGCATG | 0.002537394 | 0.011328252 | 9.82E-06 |
| 284 | 3050416 | 9 | DDC | TTGCAGATTCATTCAACTTTAATCCCCACA | 0.02980537 | 0.010140623 | 1.36E-05 |
| 1163 | 3051219 | 1 | | CCTTCAAGCTGGAGGTCGTGGCTGCAGAGGCCTCTACCCGACAAAGCATTAG | 0.00102279 | 0.00821568 | 4.94E-06 |
| 559 | 3052483 | 6 | | CCTCCAGCTCTAGGCTGCGGGGATCCCCTCTGCCATTGAGGCCTGGCCCCTCTATACTGGGCCCTGAGCATGTACCTGGCTCCCCCAGTGTACCCGAGGGCCTTGCTGTCACTGGATGGATTGAACAACTCAACCGAGTGTGCATGCTCATGCTAACCAACATTCAGTC | 0.005952617 | 0.012033356 | 1.36E-05 |
| 742 | 3052982 | 6 | | TTGGAAGCTCTACTTGTAGCACAACTTGGTTAACTTCTCTTGTGAATTTCATGTTTT | 0.032963108 | 0.009953901 | 6.39E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1444 | 3056252 | 4 | STX1A | CCCTGGAACTTGGGCTAGGTCCCATGGC CCCTGGTGTGTGTCTTTTTTTCTGTTA ATATTTTCTTATTTTTGTTCAACTTGCGGA GAGATTTTCTCTACTTTTATCTTCTAACC CCTTCTGTTTTCTTGAATTTTAAAATTTTC TGCTGTCATTTAAAAAAATTCTCCACCA GCGGCAGTGGCTTACATC GGAGGAAAGGCCCACTTCGCCCATCCCC TCTAGGTTTTGCTTGGAGCTGTGGCTGGT TTGACCATGCCTCAGAGGTCAGGCCCTC AGCCCCCCGACTGGCTTTGGGGCCAATC TCAATGCCACCTCCAGGGTAGACTTGAC CTGCGTGCCCCATCTACCCTGGCCCTGA TCTCCCTTTCCCCAGCCCTACCCTCATAG ACGGAGGGTCCAGAGGAGGATGCGGGC ATCTCTCCTCCCA | 7.08E-06 | 0.007013993 | 4.56E-06 |
| 1204 | 3058806 | 4 | SEMA3C | TCGAGTCTAAGACACCATGTCATGGATT TGAACAATGTTGATGGTGGAGACTCAGA CAAATGGGGCTGGAGAAACCTAACCTGG CTCATGAACTGTCCAAACGATGAGACAA GTTGCCCTGACAGGGCAGTTGTTTGGAA | 0.01496327 | 0.007578283 | 3.96E-06 |
| 1125 | 3062164 | 5 | DYNC1I1 | GCCCAGACACAATGGGGCGTTAGTAGAA GTCCAGTCCCTATCCCTACCCGAAGAAA GACAAACCCCTGGCGAACATCTCATGC AATAAAATGGAGGATAAACCCTTCAGCA TAATC | 0.000553994 | 0.007395291 | 5.33E-06 |
| 567 | 3062175 | 5 | DYNC1I1 | AGGGCTGTTTCCAGAGCAGTGAATGACG ACCGGAGAGCATGGGAACCCCTTTTCTT TGTAGCAGCCCATATTAATGAGATCTCT GTTTCTCTCAAGACAGTCAGGGCCGTCT GGTC | 0.000837966 | 0.007293075 | 6.55E-06 |
| 1257 | 3063591 | 2 | AZGP1 | CACAGTCAATGGATCCACAAGGCCTGAG GAGCAGTGTGGGGGGACAGACAGGAGG TGGATTTGGAGACCGAAGACTGGGATGC CTGTCTTGAGTAGACTTGGACCCAAAAA ATCATCTCACCTTGAGCCCA | 0.007770575 | 0.010789364 | 8.53E-06 |
| 889 | 3063598 | 9 | AZGP1 | TGAGATCGAGAATAACAGAAGCAGCGG AGCATTCTGGAAATATTACTAT | 0.002481187 | 0.013545858 | 1.28E-05 |
| 1094 | 3063601 | 9 | AZGP1 | GGAGACCCTGAAAGACATCGTGGAGTAT TACAACG | 0.001219026 | 0.010779914 | 8.76E-06 |
| 724 | 3063605 | 6 | | TCCAGGTAAGCCTTGGCCCGCTGCACGT AGACTGGTTCTGCCTCCTACTTCTGCTTG GTGTTCTGGGCTTCCGGGACCAAGGGGA CTCAGGCTGGGATTTCTTTGTTGAATTCA ATGTAGTCCTTTCCATCATAGGCATTCTT C | 0.001184984 | 0.012200652 | 1.10E-05 |
| 376 | 3064449 | 1 | | TGGGGCTGCCTAGCTACTCTAGAACCCA GACTTGGAG | 0.004304377 | 0.007354949 | 4.54E-06 |
| 979 | 3065014 | 9 | ALKBH4 | AAGTCCTTCGGGAATGCGGTTGCAAGGG CATCCGGACCTGTCTGATCTGCGAGCGG CAGCGCGGCAGTGACCCGCCCTGGGAGC TGCCC | 0.003217076 | 0.007568557 | 3.61E-06 |
| 625 | 3066949 | 4 | CTB-111H14.1 | ATTCTAGGGGCCAGTCGTTGGTATCCAG AGGCAG | 0.012043037 | 0.006585706 | 3.61E-06 |
| 1988 | 3067307 | 9 | LAMB1 | ATGCCAGAAGGAAAGCCGAAATGCTAC AAAATGAAGCAAAAACTCTTTTAGCTCA AGCAAATAGCAAGCTGCAACTGCTCAAA G | 1.96E-05 | 0.009872566 | 7.52E-06 |
| 1658 | 3067310 | 9 | LAMB1 | CGCATCAGCGAGTTAGAGAGGAATGTGG AAGAACTTAAGCGGAAAGCTGCCCAAA ACTCCGGGGAGGCAGAATATATTGAAAA | 5.38E-06 | 0.011224347 | 8.31E-06 |
| 1606 | 3067585 | 4 | NRCAM | AGCAAGCCCCTCTGTTCAGGGAAACCCA ATGTCCTTCAGGCTCTCCCTGCTTCTCCT TACCACGCCCACTGTTGTGGTTGTGCTGG CT | 0.000354141 | 0.009376832 | 8.46E-06 |
| 1443 | 3068373 | 6 | | GAGGCGGACGCATGCCCGGTGGCTCTAA GGCG | 0.004416632 | 0.006818008 | 5.24E-06 |
| 416 | 3070220 | 9 | AASS | TTTACATGGAATGGGTTTAAGGCTCCTTG CTTTGGGACATCACACACCTTTTA | 0.016398739 | 0.0070476 | 9.29E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 440 | 3072337 | 4 | UBE2H | AGGAACAAACAGCTCAGATTACACGGGT TTCCTTGTTGGTGGGGGTTACTCGTCTCA C | 4.44E-05 | 0.011046023 | 6.90E-06 |
| 2064 | 3074661 | 6 | | TCTAAGCGGTAATGGAGGAAGACTAGTG CTTTGTGCATTTTGATATATTTGAGTTCA TTTTTTCCACAATGTCATACTTTTGACGC AGTTGGGTTTCTCATAAGTATCCTAGTTC ATGTACATCCGAATGC | 5.67E-06 | 0.007879089 | 7.19E-06 |
| 778 | 3075021 | 4 | DGKI | CCCAGCCACCTCATGGCCTCGCAGGAGG CTC | 0.002232119 | 0.007232854 | 4.83E-06 |
| 1949 | 3076101 | 9 | SLC37A3 | CTCTCGGGTATTGAGGCAGAAGAAAACT TTGAAGAAGACTCACACAGGCCATTAAT TAATGGTGGTGAAAATGAAGACGAATAT GAGCCGAATTATTCAATCCAAGATGATA GTTCTGTTGCCCAAGTCAAGGCGATAAG CTTC | 0.001173835 | 0.008365773 | 5.62E-06 |
| 1637 | 3077525 | 2 | FAM115A | CCGCTCCCAAATCCCGGCTCGGTCGCCC AGTCACTGGTACAGGGAAGCCTCTTCCC TGTGCATTCCTCTCTGCGCCAGGCTCTGC CCGCTCCCACCTGCCCCGTGGAAATCG CAGGGTGACCTG | 0.006757381 | 0.006736752 | 1.22E-06 |
| 363 | 3077790 | 4 | TPK1 | AGTAAAAGAGGTATGCTCTTATTTAAAA ATTCATTTACTAAAAACTAGAGCTTCTGT ATGACAAATTGGAGAAATGACTCTCCTT AAGATATCTTAATGTCGGCTGGGCACCG TCGTTCATGC | 0.026532368 | 0.009554661 | 1.31E-05 |
| 1531 | 3081037 | 7 | INSIG1 | GACCAGCGCTCACAGGCAAGTTCCTCTA AGCTTCCATTCTGCTGACTGGTGGCTTCC ATTTAAAAGGAGTCTTTTAATCAAGCCA CTTTCACAGAATTTAAAACAAACCAAAC ACATGTAAATTGCAAAATACAAAAAGGT AAATTTATAAGTAAAAATGACCAAACCC ACAAAACTGGAGTATTTCGAAGGTTGAG GGTTCAGTGGAGGGTGTAACACGAAAGG AACTTCACAACTGAAAGAAATCATTGCC GAGTTTCCTCCAGGCAGCACTGAAATGA ATGGAGAACCTTCTCTCGAACATCTCAC ACGTTAAAAAAAATAAATATTTAAGAGA TACAAGGCTCAGATTGGTTTTCATATAC ATTGCACTTGAAGTTTAAGACCCAATAC TTGCAAATTAGGTCTGGTATGGTCTATGC CATTAAATGAATACATTGTGCTCACCAA TATCATTGACTAGAAACACCACACGTTT AATGCAGTGCCATATGCACTCTCCTTTTT ACAAGGCAATCACAGATTGCAAATTCCA TAGGGCTGTGGCAAAAAACAGTCATCTC TATTCTGTAGTAACAAACAAACAATTTT GGCTCACTAAGATTGAAATACATGGCAG ACAGGTATTCATTCTTAGATGACTATGG ATTTCGAAATAAACTTCATAAACTGAGG TGAAAATTCCAATATATCGCAGTGTGGG AACCAAGACTTTTCATTGCCTTTTGCTCA GTAAGATTGTCTACACAAACTGCCACGG GAGGAATGACAAGCAGTTGACCCACTGG TGATACACACGTGTGACCATGTAAAC ACGCCACTGCAGGACGGACGAGCGTGAC CGTGAAGCGTGGCCACGCCGCGACCCCA CTTAGAGTGTGACCTCTCTATAATCACTG CTGCTTTTCTTGTTTTGTTTTTTTTTTAA ACACAGCCCTATTTTAAAAATCTTTTGG ATAAATATTATTCCTATTACACCTACTT CATGTTTGTTAAGCACCATCAACCTACCT CCTTTGGGCACTGACACAAAACTGCGGG | 2.94E-05 | 0.011796154 | 8.27E-06 |
| 2060 | 3082100 | 7 | DNAJB6 | TGTTTAGGGTTACATTGTCCACAGAAAG CATCAAATACCACTCCTCTCCCCGCAA AACCAAATAAACAAAGCCAACTCTTTGG CAACAGTTGTGTTAAATAAAATCCCAGG TCACACTTGTTTCTGGCTCCCAAGCCTGG GTCACTGCTACATGGATTGCGCCAAAAA ATTCCCAGCTTCAACACTGCTAGATTAA | 0.011785961 | 0.007939522 | 6.41E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 813 | 3082532 | 1 | | AATTGCTGGCATTTTTAAATCACAGCAA AGCTTTTCACAATGCCCTCAAGTCCAAG AGGACAAAGGAGAAAGCAACATGAACG GCAGATCCTCATGTGAAAGGGA CGTCGACAGGGCAGGATCTTAGGCCCCT ACTGCCACATATGGAACAAGCTCCAGTT CCAGTCTATCACCCAGCACCTGGCCAGC CTCTGTTAGCAATACTGCTGACTGAAGA AGAACAAGTTAGAACAGCTCAAAGACTA AGCCTTCTACAGTGTCTGCCTGAAGAAG TTTATGACCCTGGAAGAGATAAATCAGA AGAGGAGATGCCAGAGTGTGTGATCTGT TTACTGGAATTTGTTTGTGGGGACCCCAT TCGATGTCTGCCATGCAAACACTTCTTTC ACCTTGACTGCATAGACACATGGCTGCT GCGATCTTTCACATGTCCCTACTGCCGGG GGCCAGTGGATGCAGCGCTGTCTACATC CTTGGGA | 0.000206799 | 0.008814925 | 6.04E-06 |
| 1096 | 3082626 | 5 | ERICH1 | GGAAATGGCCACATGTGAACCACCATCC CCTGCAAGGGCAGGGATTCTGTGCAACC CAGGAAAAGGCTACACATGACCCACCAC CCCTGCAATGGTGCATTCACTTGCAGGG GATGGAGA | 4.91E-05 | 0.009444815 | 6.17E-06 |
| 1132 | 3083218 | 5 | CSMD1 | AGGTTATTTGAAGCCACGTCCTGCAGCT TCACCTTCTCTTTAGGGTTTTAGAAGTCA CTACTATTCTGGCAGGCACTGTCTTGTCT GACTATGAATAGCGTATTGGCTTCATGC TCACAAGGACAGGGGCATGAGCTCACTT TCTACAAGGACCAGTGAGCTGTCCTCGG TTCAGGGACAGCACCCTGTGCCGTCATT GCACTTGGACGCTGTTCAATGTGCATA | 0.003855932 | 0.008232629 | 5.74E-06 |
| 1384 | 3084878 | 1 | | GTCAGCATCACAAGACGCATGAAAGAG GACTCATCGCCAGGGCATGGAGC | 0.003420783 | 0.008068285 | 1.37E-06 |
| 448 | 3090530 | 4 | DOCK5 | GGGGTTTGTTAATCAGATCTCCTTAAGGT TGGAAGAGTAAATTCTCCCCTCTCCATCC AAAGGGGAAGATGCCTGTGTCTCCTGGG TTTTTTCCAGGTGGAGGTTTTGTTATAAG TAAGGTTTGGCTGTTAAATATCTTCCCTT TTTTAAGAGTTCTAGGAAGGAAGTGTGT TTGAGGAGGTTTGAGCCTGCAAAGTGGA AGTGACACTGTGGGTTGCACGGTTTGGC CACTGACTTCTCACGTGGTTTCAGTCCTT AGCACCGTGGTATTGACATGACATC | 0.02092529 | 0.006719573 | 4.33E-06 |
| 1077 | 3090561 | 4 | DOCK5 | TTCTTGGATGATGTGACAGTGGCGGATA ATGCAGAAAAGG | 0.011465942 | 0.007494898 | 6.10E-06 |
| 553 | 3090589 | 9 | DOCK5 | GCTTGTTAAATTGGCGTTCCAACTCCCAG AACA | 0.00084815 | 0.008174387 | 6.42E-06 |
| 955 | 3090592 | 4 | DOCK5 | ACACCAGTGACAGTGGCCGTTCCACCCA G | 0.042066262 | 0.007251473 | 6.58E-06 |
| 1060 | 3093827 | 9 | KCNU1 | TGGTCTGATACTAAATCCACCTCCACAA GTGAGGATACGTAAGAACACATTAGGGT TCTTTATTGCTGAAACTCCAA | 2.12E-05 | 0.012045129 | 4.30E-06 |
| 1249 | 3094697 | 5 | FGFR1 | TGGGCTGGCTGCAGACCGCCCTCTCTCA GCTCCCTGGTCAATGCACTTCAAATTC | 0.000120755 | 0.006868788 | 3.88E-06 |
| 578 | 3097271 | 1 | | CCTCTCTGGAAACAACGGCACCATGAGC CACGTGGAGCACCAAGTTCCTGTACAAG CGGGACCCACTGTGAGGTGTGCCACCCC ATCAGGCGGTGTGAGGACCTTTTGACGC CATTAGCAGAGTGGAGTAGAAAAGAGTT TAGTGTCTCCCCAAATCACTGGGTTCTTC AAAAAGTTGTTGGGCAAATGCTCAGAAC CCAAGTTAAGGTCTCAAGCAAGTC | 0.006687861 | 0.010902639 | 1.13E-05 |
| 1107 | 3099025 | 4 | LYN | TGAATATAATATACGGGCTGTGGAGAA AATATTTGTAACATTAATTCTATATTGTT TATTCCAGCCTTTTAATTACAAATTAAAA CATGAACATTACCATACACACAGAACTA AATATAATGCAAAAAATCTACTTCTTTAT TTTCCCACATTCTGTATTATATATATGAA CCAAAAATGCACAGAGAGGCCTAAGTTC CCCAGCCTGTGGCACATTGTCAGGGGGC | 0.000180795 | 0.007929824 | 4.64E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CAAGCATGGTCGGGACTGCAGGGCCTTT CTTGGGCTAGGATTGCCCACGTGGTTAT GACTGAGGATTCTTATGCTCTCACCCAC GA | | | |
| 1711 | 3100547 | 3 | CLVS1 | AGCCTCCGCTTGCACCGTCTAGAGACAG GCAGGCACCTTTCTGGGCAGCGTGTTCC CTGTGGTGTGGCCTTGTTAAAAAGCACT TGCTTATTCTGAGTAAGATGACATAGGT CTGCCCTCTGAA | 0.031155964 | 0.008689629 | 4.81E-06 |
| 2000 | 3101370 | 7 | ARMC1 | TAGGTGCCCTGAAAGTTATTGTTGCTTTT TTTGTTTTTTTTTTTTCAGTTTGTGCGTGT CACTTGAATCAGAAACCAAACACATGTA AAAAAATATCATCCTCAATGCCCCCCAT TAACTCTCTCTCCAGAAGGTGACAATGT TAGTGAACTCAAGACTCTCACTGATGAT GGTATTTTACAATGAAAACACAAGGAAA CCCTTTGAGGTCCAATTTTCACATCATAT TCTCCAAATAGTAAAATAGCAGCTCTAC ATGTTGATGAAAAGAAATTTCAATTTCTT CCTATTTGTTTTTACTCATATCAACATTA ATATGTATCTGGATTTATTAATTTCCAAA AAGAAAATTTTAGTTACCAAATATTTCA GAAATTTAATAAAGCATTACATATATGT AATTAGCACTTATCTACCAAAAAAACAT ATGTGTATGTATTTATTTATCTTACCTTC ACTGAAGTTCTTTTTTCTGGCTGGACATG AGAAACAGGATTAAGTGATCAATGCTGG CTTTATTTCTTCATAAGCAGTAATTTGGG TCTTTTTCATTCAACACAACGCAGCATTT TCATAATAAATTCACAAAAGACAATACA AAGAAACACCTACTGAATAGAACTCTGT CGAGCAATTCATGTTTTAAAGTTGGACT CTATACCAAACTGGCATTATGGTATTAT AGGCATTTGATTTTTGTTTTCTTATTTTCA GTTTGTCAGTTTCTTTACTACCATTATTTT TTTCTAGCCGGAGATAACGTATAATCA | 0.001873579 | 0.008741283 | 4.65E-06 |
| 1952 | 3102393 | 9 | SULF1 | GGGAAGCCTCTGTTCGACTGTCAGATCC CCGAGGTTCAGAGGACGGATACAGCAG GAACGAAAAACATCCGACCCAACATTA TTCTTGTGCTTACCGATGATCAAGATG | 0.00035324 | 0.009114519 | 5.56E-06 |
| 1870 | 3102402 | 4 | SULF1 | CGGCATCAGATCTTTGGGTTAGTCACTAT TGCTGGCTTTAAAAGAAATTCCTTGGCTT CAGGTAGTTCCTGGAAATTTTTCTAAGC ATTATGGAACAGGTTGTCCTAGACAGAA GTAGCATGGCCTGAAGCCAACAATAATT ACAATCAGGTCTTCTGATCTTTCTCCCTG CCCCCCAACCCCCACCACCTTCTTAAAC AGCTGTGAAGGGAAGTGCTTAATGGTAT CCAAAACAAAGAGGATGGGTAAATGGC ACATTAGTGATGTATTCAGATAGTAGGA GTTGAATTGAATTGCCAATGCCGAAGGA TAGAAAAATATTGAACTATACGTAACCT ACATGTAGACATAATGGCAGTAAGGGCA AGAAAGCTAAATTCACCTTAGGAAGGGA AAAAGAGATTTAATACATCTGGAGGAAA ATAATTAGAGGGCCAGATAATCAATTGC AGAGCGCCGCCAGGAAACATCGTGTTGA AAGAGGCCGGGGTGATTACAAACGAGTC TCAATGTCATGAGGCAACAAAAAGGCCA GAGCAACTGGAGGCCAACAGTGCTGCAC CCTGACACCCAAGGCCCCCATCAGCCTT GGAATGAGTGTGATGGGTGAGCGCACAT CTGGAATACTGA | 0.000740426 | 0.007834969 | 3.81E-06 |
| 1343 | 3102414 | 9 | SULF1 | GTCCCACAGATCGTTCTCAACATTGACTT GGCCCCCACGATCCTGGATATTGCTGGG CTCGACACACCTCCTGATGTGGACGGCA AGTCTG | 0.000462937 | 0.012550374 | 8.12E-06 |
| 828 | 3102439 | 9 | SULF1 | GCTCAGGAAGTAGATAGCAAACTGCAAC TTTCAAGGAAACAACCGTAGGAGGAA GAAGGAGAGGAAGGAGAAGAGACGGCA | 2.80E-06 | 0.015931026 | 1.68E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 2010 | 3102445 | 9 | SULF1 | GAGGAAGGGGAAGAGTGCAGCCTGCC TGGCCTCACTTGCTTCACGCATGACAAC AACCACTGGCAGACAGCC CACACGGTAGAACGAGGCATTTTGAATC AGCTACACGTACAACTAATGGAGCTCAG AAGCTGTCAAGGATATAAGCAGTGCAAC CCAAGACCTAAGAATCTT | 0.000194662 | 0.008480409 | 5.98E-06 |
| 1759 | 3102461 | 2 | SULF1 | TTGCACTGCTGAAGAGTCACTATGAGCA AAATAAAACAAATAAGACTCAAACTGCT CAAAGTGACGGGTTCTTGGTTGTCTCTGC TGAGCACGCTGTGTCAATGGAGATGGCC TCTGCTGACTCAGATGAAGACCCAAGGC ATAAGGTTGGGAAAACACCTCATTTGAC CTTGCCAGCTGACCTTCAAACCCTGCATT TGAACCGACCAACATTAAGTCCAGAGAG TAAACTTGAATGGAATAACGACATTCCA GAAGTTAATCATTTGAATTCTGAACACT GGAGAAAAACCGAAAAATGGACGGGGC ATGAAGAGACTAATCATCTGGAAACCGA TTTCAGTGGCGATGGCATGACAGAGCTA GAGCTCGGGCCCAGCCCCAGGCTGCAGC CCATTCGCAGGCACCCGAAAGAACTTCC CCAGTATGGTGGTCCTGGAAAGGACATT TTTGAAGATCAACTATATCTTCCTGTGCA TTCCGATGGAATTTCAGTTCATCAGATGT TCACCATGGCCACCGCAGAACACCGAAG TA | 0.000177948 | 0.009249871 | 6.69E-06 |
| 2037 | 3102463 | 2 | SULF1 | CCCTGGGTACCTTTGTGCAGTAGAAGCT AGTGAGCATGTGAGCAAGCGGTGTGCAC ACGGAGACTCATCGTTATAATTTACTATC TGCCAAGAGTAGAAAGAAAGGCTGGGG ATATTTGGGTTGGCTTGGTTTTGATTTTT TGCTTGTTTGTTTGTTTTGTACTAAAACA GTATTATCTTTTGAATATCGTAGGGACAT AAGTATATACATGTTATCCAATCAAGAT GGCTAGAATGGTGCCTTTCTGAGTGTCT AAAACTTGACACCCCTGGTAAATCTTTC AACACACTTCCACTGCCTGCGTAATGAA GTTTTGATTCATTTTTAACCACTGGAATT TTTCAATGCCGTCATTTTCAGTTAGATGA TTTTGCACTTTGAGATTAAAATGCCATGT CTATTTGATTAGTCTTATTTTTTTATTTTT ACAGGCTTATCAGTCTCACTGTTGGCTGT CATTGTGACAAAGTCAAATAAACCCCCA AGGACGACACACAGTATGGATCACATAT TGTTTGACATTAAGCTTTTGCCAGAAAAT GTTGCATGTGTTTTACCTCGACTTGCTAA | 0.000131986 | 0.008176341 | 7.53E-06 |
| 1982 | 3102464 | 2 | SULF1 | GTGCCTAGCCTCAAAGCGTTCATCATAC ATCATACCTTTAAGATTGCTATATTTTGG GTTATTTCTTGACAGGAGAAAAAGATC TAAAGATCTTTTATTTTCATCTTTTTTGGT TTTCTTGGCATGACTAAGAAGCTTAAAT GTTGATAAAATATGACTAGTTTTGAATTT ACACCAAGAACTTCTCAATAAAAGAAAA TCATGAATGCTCCACAATTTCAACATAC CACAAGAGAAGTTAATTTCTTAACATTG TGTTCTATGATTATTTGTAAGACCTTCAC CAAGTTCTGATATCTTTTAAAGACATAGT TCAAAATTGCTTTTGAAAATCTGTATTCT TGAAAATATCCTTGTTGTGTATTAGGTTT TTAAATACCAGCTAAAGGATTACCTCAC TGAGTCATCAGTACCCTCCTATTCAGCTC CCCAAGATGATGTGTTTTGCTTACCCTA AGAGAGGTTTTCTTCTTATTTTTAGATAA TTCAAGTGCTTAGATAAATTATGTTTTCT TTAGTGTTTATGGTAAACTCTTTTAAAG AAAATTTAATATGTTATAGCTGAATCTTT TTGGTAACTTTAAATCTTTATCATAGACT CTGTACATATGTTCAAATTAGCTGCTTC | 4.81E-05 | 0.008098921 | 4.23E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1380 | 3103453 | 5 | UBE2W | CTGATGTGTGTATCATCGGTGGGATGAC AGAACAAAC CAAGCCCAAATTATGGACTGCAGCAATT TAATCATCACTGCCATTTTTCTTACTTCC AAAATAAAGCCTTGATTAAACCATTCAT ACCCTATATTACTCATACCTTTACTTCAG AGATTGAGGAACTATATACAACAAATTA ATTTATTTTCACCATAGGGATAACATACT GTACCTCTCTGCCAATGTTACTTGAAAAT CTTCCATGTCAAAACAACTTGACAGTAG ATATAAACAATTCAATAAATATGCAATG ATCTTTCATTACAGTCCTTTAAAGACGCA TGTTAATTCATGCTGTTAACCTTAGGATC ACAGTGCATAGAATCCAAATATAAACAG TTGGGGTGACTTTTAAAGTAATGTTGGA TCCCTCACTTTATTTATATTCCCACTATA ACCAGTAAGTTCATTTCATAGGCCCTATC ATGCATTAATCATTGAATGGCAGGAGTT AATGAAAACTTTTCCTGTTACAACGCCC ATTGCCGGCAATGAACGTACCAAAACCG CCAAGGAAGTCATTGTTATTGCACAATA CATGAGGACCTGG | 5.92E-05 | 0.010791524 | 6.97E-06 |
| 1576 | 3103632 | 2 | GDAP1 | TAGCTAGACCCTGTGATTGCCCGTGGCT CTCTGAGTCTGTCTTATTGAGTAGTTAGC AGTATTTTTCCTAAAATTCAGAAGTCAT CTTTGTTACACAACACAGGGGTTCAGGT AGCAATAGGACACAAAATTGCTTTATTC TACAACTGCCAGCTCCAGGCAGAAATAG GAAGGCAAAGAGATAAGAGAAGGAAAA ATGAGAGAATGAAGTCTGTATAGGGTAG AGCAATAGAAAGTAAGCTTGGGTGCCT CCAACGTTCATGGCTGCCTG | 0.000629941 | 0.011534464 | 8.50E-06 |
| 218 | 3103710 | 4 | PI15 | CAGAGAGGTGGTAACTCCCGAGTAAGCA ATGCCAATCCTTCAGGCAAAGATAAGGA AGAACCGCACAGCTGCTCCAACATAAAG TGG | 0.000674778 | 0.015711899 | 1.73E-05 |
| 1528 | 3104056 | 4 | ZFHX4 | GAGAACCCAGATAAGGTAGCTAATACAT AAATCTGAAACAAAATGCATGACTATAG AAAAAGAGAGTCTTGAAATACGGGCAG GTTTTCAACAAGGGGAGAGGGAAGTGAT TAGGTAGTGATACTCCAGATGAAGTAAA ACCTGGGAAGCAAAGGCTCTGAGTTTCA AAACCACAGGGTGTGTTGGAGGTCAGTA GCACAGTTTGGCTGAGATGCATGGTA | 0.0001169 | 0.006655882 | 2.13E-06 |
| 2071 | 3104305 | 2 | PKIA | CATGTCTTTTTTCAGCCCTCTCAGATCCA AATGTTATTATGCACTTTTTAATGTTTGT AAACTTTTACTAATAATTAGTGTGAATTG CATTCTGATACAATAATGATTATCATTAG AAGCTAACAAAATTCTCATTAATACTGT GTTTGATGGCCTCTGCTGTGTTTTAACAT CGTGCTTCTTATATGGAAAGTTTTTGTGA GCTGTGTAATCCCTCGGTCAGTATTATG AAATCA | 0.001547455 | 0.007394509 | 6.93E-06 |
| 1986 | 3104626 | 5 | TPD52 | TAGGAGGTTCCACTCTCAAGTCACCTAG AAGTTTGATTACATATTGTTACTTACAAA ACTATAATAAATTGGATGCACAGCTGTT TACTTCAGTCTGGTGTCTTCAACCAAAAT ATGTACCTTATACCAAAACAATGCTTATT CCAAAATATTTTTTGTAGCTAGTAGTTCT TTCCTTGGA | 1.85E-05 | 0.008255373 | 5.59E-06 |
| 1893 | 3104778 | 7 | ZNF704 | GGAGGTACTTCCCTTCAGGTCATTCTCTC CTTGCTTCAGGCAGCTGCTCCCAGAGGA GAAAATGGCAGCTCCCTGGGAGGTACTT AGGGATGGTGACCACCAGCTGATCAGCA CCAAGAAGATGAGCAAGAGCCAGGTGT CCACAGCCCTCTTGTACCTCCCCCCTGAC TCCCTTGCTACCTGTGTGTTTTCTCCAGG CTGTCACACTGCCTCCCACCCACCAATG CAGCACACATCTGCTGGGAAGGCCCAAG GCTTAACACCACTGCCTGCTGGCCACTCT | 0.037111478 | 0.006548322 | 6.22E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1577 | 3105433 | 9 | LRRCC1 | GCTTTGTCGCTCTCTGGAGAATGTCCTGT CAGTCACTATGAAATGACTTCTTTGGAG AGAGATGAAAAACCTTTTCTGAAGGCTG GGGTGTCAAAGGATAAAAAAAAAATCA AAAGGCTACATCATGCCTTACTTAGAAA TATTTTGGGACCAGAATCCATTGTTTTGC ATGCCTTTTGCGTAGATTGGCCTCTG GAAGTGGAAAACGAAGACGGCGACAGC AGCTGCGGGGATGTATGCTTCATGGACA AA | 0.000172838 | 0.007157123 | 2.51E-06 |
| 1183 | 3105924 | 9 | CPNE3 | CTGGCTCCAATGGTGACCCAAGGTCTCC AGACTCCCTTCATTACATCAGCCCCAAT GGCGTTAATGAGTATTTGACTGCTCTCTG GTCTGTGGGACTGGTCATTCAA | 0.009861702 | 0.007692419 | 7.28E-06 |
| 1055 | 3106288 | 9 | OSGIN2 | TGCAATACTTTGGTGACAACTTGGGGCG AA | 3.12E-06 | 0.012037745 | 1.11E-05 |
| 1802 | 3106314 | 4 | DECR1 | GAGCACTGACCTTTGACGTCCTTTGTTGT GAGGAAAGTCCATCTATGTGTTAGTTAT GGAATTAAACACTAATACAAACAAATTA TCATAAAAATGAAACAAAAACAAAACC CCAGCTGTTTATAGACTCCCCTTCCCAGA TGTATAGCTGGGAGAGGTCCGTCTCACA CTGGCTTCCCCCCTCTCTCTGGCCCACACT CCTGTCACCATCTCCATTGCACCCATAGT GGAAATAGCTAGGAAGTGAAAACAGCT AGGAAGAAGAAAGAGAAACAAAACAA AAAGAAGCAATAATATCCAAGACAAGC CCTCCCCACATCTAAATTACAAAATTGTT ATAAGTAAACTAAAAAGCACATTTTCTT TAGCCAGGTAGAAAAATTAATATGTCAA CTGTGAAAAACTTCTTTTGATTTGATAG AATAGACAGCCATGGTGTTGTTTTTCA | 0.004800285 | 0.007172927 | 6.53E-06 |
| 881 | 3107647 | 6 |  | GATTAGTTTCAGTGGTTCTCATTTCACTT TTATACGTAATTTCTTAACTATATTAAGA TAGTTGCAGGCAGTGTACCTCAGGTTGA CTCTGTACATCTGAATAGTGAGTCACTA GTATTTTGCTTCAAGCCTTCTGAAAATAT AACCATAGTTACCTAAGCACACAGTGAA TAGTCACATGGTAGTACTTG | 2.38E-05 | 0.016569088 | 1.45E-05 |
| 612 | 3107695 | 3 | INTS8 | GATAGCACCATAAGCCAAACATTTATGC TAATTTTATGTAAATTATGTGCTATGGTC CACGCCCCGCCCCCACATGCGATTAAAA AGTTGATTTTTAGTGTGCTAAAGCACAT GCTAAAACAGATGCTACATTTTCAAAAG GCAAGGGTCTTTTAGAATGCTTGATGTCT GTGAGGTTGACAGGAGCAATATTAAATA AATATACATACACTGTTTAAGGATTCTGT G | 0.004639335 | 0.010553457 | 9.22E-06 |
| 1316 | 3107732 | 4 | C8orf38 | TGACCTTACCTAGGATATAGCCTGGCAT CATGTAACATAAGAAAGTTGTTTTCATTT TGGTACAAGCAAAATGAAATATGTTTAG CCTCATAAAAAATCATCTACAATATTGA GACTTGAGAGTATGGCAAACTCTGGTAA AGTTAATAAATTAATGTGCTGCCTAGGG TTTGTTTATATCTGGAAAACAGGAAACG GTAGGTAGGTAGGTAGGTAGGTACATAG GTAGATAGATATAGATAGATAGATAGAT AGATAGATAGATAGATAGATAGATAGAT ATAATACAATACTTTTCTTAGAGTCAGA GCCTGGACATGACAACACTAACAATAGG GATATTCTGAACTGCTCCAAGGATCCAA ATCCACCTGGACCCTCAACCTAAGAGAG GGAATGCCAACATTC | 5.22E-05 | 0.008155705 | 5.18E-06 |
| 1812 | 3107789 | 4 | C8orf38 | ATAGAGTAATTTCAGTAGATGGTTGGGG GTCAAACTGGAGTATAATGGGTTAAGAA GTAAGTCAGGAAGTAGAGGGCTTTTCCT GGTGTTAGGGACAATATAAATGAAGACA TGGAGACAGGAGTGGGCTTGGCGAACAC AGGATGATGGGCATCAGCCTGAGTGACC AGGTGTTCGTAGCTCAGA | 0.000450333 | 0.007765135 | 5.80E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 499 | 3107876 | 4 | KB-1047C11.2 | TCTGAGGCACATACACAGCTGGTTGGCAGTTCTGCTTCTAAAGCTGTGGCACTCCCCATCTTAAAGGTTTTGAATCTGCCTGCTGTTCCAGACATGGGA | 0.033900726 | 0.007197605 | 3.82E-06 |
| 1670 | 3108459 | 9 | MTDH | GTCTGTAAAACTCTCCTCACAGATCAGTGCAGGTGAGGAGAAGTGGAACTCCGTTTCACCTGCTTCTGCAGGAAAGAGGAAAACTGAGCCATCTGCCTGGAGTCAAGACACTGGAGATGCTAATACAAATGGAAAAGACTGGGGAAGGAGTTGGAGTGACCGTTCAATA | 0.006687861 | 0.00668549 | 3.67E-06 |
| 2039 | 3108479 | 2 | MTDH | GCCTTAACCTGTAGTGCGTAGAATATGCATCAATTTCTTGAAGGAGATTCATGTTTTTATAAGAATTTTCATGTAATTATTGCAATTGTGGTCAAATAAGGAACGTTTCCTGCTTGAAATTATATTGATTTAAATGATGTGTGAGATGTTTCACCATTTTCAGGCACTGTGTAATTCTATTGTAATAAACTGGCAGGTATCTTTGTAACTATAAATAGTGCATGCTCAGCCATGTACACTGTAAATAGCCTTTACCAAACGTGTTTGACAAGGACCATAATTAACATCACTTAGTGAATTGTGATAAAGAAAAAAAAGCCATGATTTATTCGATGTGATTGGCTTGTTTTTATGTGGCGCCAAGAACGAACCTGTTTAACAGCTGTAACCAATGGTACTGATCTATCCATCCAATGTTGTCATTATATTTGACTGTGGTTCAACAGTATTGCGTTGTCAGACTAGGAAAGCTAAACGAACAAAATGGTTTTAGTTTTGCTGAAGACTGGCCTTATTAATG | 2.93E-05 | 0.006961325 | 4.37E-06 |
| 1345 | 3108839 | 5 | STK3 | ATGGCTATAAGAACACACCCAATGCCAGTCTCTACCACACCGCAGCAGCATAACTTACTACAG | 1.98E-05 | 0.011035218 | 8.64E-06 |
| 1016 | 3108873 | 4 | OSR2 | ACATCTTCCTTGGTGACAGCCAGTCAAGTAAATTTTACAAAATTTCTCCACATGCCTGGAAATTCCTGTGAAGAAGACTGATGAAAGAAAAGTAGCCTCAGCTCCACCAACATATTTATGACTTTTCATTGGTTTAAGTTTCTTTTCCTTGCAAGATTAAAAGTAACCAGTGGTCTGAAACGGGACGGTGGAGAAATGACAGCAGATGATGATCGCTGTTATTTCCTGAAAGGGAGTGTGGGAACTACAAGGCTCAGCTCTA | 0.002531721 | 0.006675267 | 5.33E-06 |
| 533 | 3109199 | 2 | POLR2K | CTTATCTTCGGGAGATACATTCCAAGGCCCCCAGTGAACTCCTGAAACCTCAAACAG | 5.32E-05 | 0.017958214 | 1.73E-05 |
| 1500 | 3109252 | 3 | SPAG1 | TGTTGCTTCTTTGGACCACTTGGTGGCACTAGATTTACCTTCAGGCAAGCCACTGATGAACCGCCAGCATGACTTCGGGTGGCACTGCCATCATCCACACTACTGCTTCCACTGTTGTGCCTGAATTTGGATGGCTTTGACTCA | 0.000306094 | 0.010773506 | 7.30E-06 |
| 1916 | 3109448 | 6 | | GTGAACCGTTTCTGCCCTTATCCAGAGTAAAATGGGTCACAACTTTGTCTAAAGGAACACTTCTGCAGCTGTAGTCAAAGGTGTACACATTGAGTATTCCACAGATATACATGGTTTAATATGTGGTATCCATGGGGTATGATTCTACCACAGCCTTGTAAGTGCTCCAAACCTTAAAGTACCCACAATTACTACACCTGTGACTGGAACCAATGATCCCTTTTATTCCCCGCCAGGACAAACCAGTATGTAG | 9.77E-05 | 0.012137832 | 1.07E-05 |
| 797 | 3109660 | 8 | KB-1930G5.4 | CTCCTCTGAGCCAAGAACGACAGTGATGCCAGTGTCTCCACTGCTGCAAAGGTTCTCATTTTGTTC | 0.009842021 | 0.007123883 | 3.92E-06 |
| 1704 | 3109903 | 7 | UBR5 | GTAGTTAAGCTGCTCACGAACATTTAAAATTTTCCAAAATGTATCTTCAATAATCATGATCTTATAAACATTTTACAGTTATCAGAAAGTGCCCAGGCTGAGTTTACATAACTGAAATACCTTAGTACAAATGTCTAGTTAGAACTGAAGTGCAGTAACCTCTTGAGAC | 0.000260842 | 0.007334514 | 3.82E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1805 | 3109920 | 5 | UBR5 | TGACTGCTCATTGAAATAGGGATACAAA GAAAAAGTTGATTGTGATAAAAGTATTG TGCATTGGCCCCATCATATGTACAAAAA AAGTGCCCTCACTCAAATGAGCAAATTA CATGCAAAATATTAGTGATATCATTTAA TATCCTAGAGCTCAATGCAGTCAAACCG TGCCTTCAAGTGTTCGTAAGCTAGCTTCT TCTCGCGCAGTCATCCTCTCTCTTCTCGC TGAATTCTGAGAAGCGTGAAGAGGATGA TTTGGATGTCCAGGATCACCAGCAGATG CTAATGCAGAACCATAACGTAATTGAGC TTCAGTAGAATCCATAATACTGACCATC CAGTTCCAAGTGGGAATAAGCTTTTCTTC | 0.000103742 | 0.009519129 | 5.07E−06 |
| 1049 | 3110126 | 4 | KB-1507C5.2; KB-1507C5.3 | GAGATTGCCACGTGATTGCCCAGTGTGA TTGAAAGTTTGAAGTCCGTATTTCTCTGA AAACTTTGGTGTATCTAGATTCTGTATGT CTCTTGGACAGATGAAGAGCTGCTGTAC ACAGAAGGGAGATTTTTTTTTTAATTGA GGAATCTAACTCAAGAATAAATTCAAGG CCAGGTGCAGTGGCTCACGCCTGTAATC CCAGCACTTTGGGAGGCCGGGGTGGAAG GATCACCTGAGGTCAGTAGTTCGAGACC AGCCTGACCAACGTGGTGAAACCCTGTC TCTACTAAAAATACAAAAATGAGCTGGG GGTGGTGGCGTGTGCCTGTAGTTCCAGC TACTCAGGAGACTGAGGCACAGGAATCA CTTGAACCTGGGAGGTGGAGATTGCAGT GAGTTGAGATCATACCACTGCACTCCAG CCTGGGTAACAGAGCAAGACTCCATCTC AAAAAAAAAGGAAAAGAAATTTGGATC CTTTAGAAATCTTCAGACACTTGGCATA ACATGAAGTTAAAACAACACCCCACTTA GTTCCATGATATTTCTGATGAATAAGAA ATATGACACCACAGAGTGAAACCAATAT TTTTAAAAACCTCCTGAAGAGACTTTTTT TCTTTGTTGATTACCATCCAGAGACAAC ATTTGTTTGAAACTTTGAACAGAATCAG TTTGTAGGGATGAAACCCTCATTCTTCCC CGCCTGGGCCCAGACTTTCCATATCTTGT ACTCTGAGAACCTTAAAGTCTTGAAATG ATTTGCAGTCCCAGCGAAGAAGCTAAAA TCAAAACTGATTTGGGGAAAAACCGTTT ACTTTCTGACCTCTTTGTACTCTTCAGAG AATTTTTGTATGCTTGTTTATTTTCTTAAT GTCTCTTGGTAATGTTTTTTCCTGTTTTG GTTTCATATATGAAATGTTCCATCTGTGT ATTCATTTTCTGGATTTATTCCCTAGAAT TTTAAGTAAGAGTGTTTCTCAAACTTTTT TTTTACTCCAACCCACAATAAGAAATAT ATTTTGCATGTTAACCTAAATACACATAT ATTTACATATATATCTAAAACAAGTTTCA TGAAATAATACTCTTGCAATGAGGTATG CACTATGGTTTTTTAAAATTCTATTCCAC TTTATATATACAAAAGTTGGGACAGAGG TTCAGGAGCAGGGAAGGGATGAATAGG CAGAACACAGGGCACTTTTAGGGCAGTG ATAGATGCATGACATTATACATTTATCA AACCCCACAGAACTGTACAACAAAAGA GTGAATCCTCATGTAAACTGTGGACTTTT TATTATTATTTTTTAAGACAGGGTCTCAC TCTGTCACCCAGGCTGGAGTATAGTGGC ACAATCTTGGCTCACTGCAACCTCCACCT CCTGGATTCAAGTGATTCTTGTGCCTCAG CCTCCTGAGTAGCTGGGATTACAGGTGC ACGCTACCATGCCAGGCTAATTTTTATAT TTTTAGTAGAGACAGGGTTTCACCATGTT ACCCAGGCTGATCTCAAACTCTTGGCTTC AACTGATCTGCCTGCCTCGGCCTCCCAA AGTGCTGGGATTATAGGTGTGAGCCACC CACCATGCACGGCCAAACTATGGACTTT | 0.025777155 | 0.007009345 | 8.94E−06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GGTTAATGCTAGTGTATCAATATTAGTTC ATTAATTGTATCAAATATACTTTCTGTGC AATTTTTGTGTTAACCTAAAATTGTTCTA GAGCATATTATAAATATTTGTAAAAGTA AAACACGAAGTTGGATTTAGCCTACTAA AATTGACTTTACTATCCATTAATGACTTG CTTTCCATGGTTTGAAAACTTGTGGCCGT GGCCTGGTGGGGAGTACCCTGGGTTTCT CTTAGGTTGGTGCAAAAGTAATTGCGGT TTTGCCATTAAATGGCAATTACTTTTGCA CCAACCTAATAACTACATCCCAGCCTCT GTCACTCTATAGAGCCTGCCCTTCAACA AGCCACATAATAATGTCTCTCAGCTTTCT CATCTGAAAAATAGAGTGTTTGATCAGA TGAATGCCAAGGTCCTTTCCAGATCCAA AATATTATACCTGTAAGTATAAATTCTCA TTTTAAAATGTCTTAGAGTAAAAGAAAA GTCATGAAGCATGAATTGTAAATTATGT GCATGTTATTTAGGCATGTTTTATGTTTT ATAGGCATCAAATGGGTACTTTTCATCTT ATTTAAAATAAGTAAAATGAAAAGTAAT TGTTCTCCAGCAAAATATATAAATTACA TTTCTCTCTGAGTTCCTGATTCAAGATCT CTGTAGAAGAAGAATAACAAAGAACAC CTAGGAATGATACAAATGATACTTTCAA TTTTGGCACTTGTCTGCCCTACTGCCATG TCCTCATGAGAGTATCCCTGAACTCAGTT CTCGTTGGTCATTTGACGTTTGCTGGGAG CGTACTATGGGCGAGGTCTTATGCTGAG GGTGAGCCTAGTGGTGTCTCACTTCTTGT AGCTTGGGTCAGGAAATGGAGATCAGCT ACTGTATCCCAGAACCTTCTTGCCTTCCC AGTCCCAAGGCAGGTGCTGTGGGAAGAG TGTGTATAAGGTCTGATGGGACAGACC TGGGGTGAATCTCAGTGGCACTT | | | |
| 439 | 3110185 | 9 | ATP6V1C1 | TTAAACCACAACGACTGGATTAAGCAGT ATGAAACACTAGCCGAAATGGTAGTTCC AAGGTCTAGCAA | 4.20E-06 | 0.017215388 | 9.26E-06 |
| 213 | 3110198 | 2 | ATP6V1C1 | CTCACTTGCTATGCTGCTTCCAGGATTTT GTTATATGCTGAGGTGTAACCATTTGTAT TGTCTGACTTTCGTATGATTTAATTGAGC CAAATTTGGGTCAGAACACAAATTTGAA GATGACTTTTCAGTATATGATGGGTATTT A | 1.58E-05 | 0.023734636 | 1.63E-05 |
| 1975 | 3110329 | 9 | CTHRC1 | GGCCAATGGCATTCCGGGTACACCTGGG ATCCCAGGTCGGGATGGATTCAAAGGAG AAAAGGGGGAATGTCTGAGGGAAAGCT TTGAGGAGTCCTGGACACCCAACTACAA GCAGTGTTCATGGAGTTCA | 0.000134132 | 0.00898655 | 5.05E-06 |
| 1548 | 3110790 | 4 | RP11-127H5.1 | TTTGCATCCGGACTGGATTTGGATGCAG CCAATCCTCCTTTGGCTGATGGAATAGTC TCCCCTCCCCACAGCCCCGGCGCGCCCC TCCCTCGCGCCTCGCCGCCTCCCGCCG CAGAACAGGAGCTG | 0.000101783 | 0.00824034 | 1.85E-06 |
| 441 | 3112570 | 4 | UTP23 | CCAGGTGCATAATTTCCCATCAGTCTGTC CTTGTAGTAGGCAGGGCAATTTCTGTTTT CATGATCGGAATACTCAAATATATCCAA ACATCTTTTTAAAACTTTGATTTATAGCT CCTAGAAAGTTATGTTTTTTAATAGTCAC TCTACTCTAATCAGGCCTAGCTTTGCTCA TTTTGGAGCCTCACTAAAATAACAGATT TCAGTATAGCCAAGTTCATCAGAAAGAC TCAAATGGAATGATTTACAAAATAGAAC ACTTTAAACCAGGTCAGTCCTATCTTTTT GTAGCTGAAGGCTATCAGTCATAACACA ATTTCGCGTACACCTCTGCTCATTATGGA ATTACACTTAAAACGAATCTCAAGAGGG TGACCATTGTTGTTTCAGATACCATCCCT AAGGAGAGTGGTTAACAGGAAGATTGCC AGTGTTACTGATGGAAAGAAGTGTTTGT | 9.04E-06 | 0.021427543 | 1.64E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1043 | 3112714 | 1 | | TTGTTTTTTTTCTTGTCAAAGACTTACACCATAGTTTTAAATTAAACTGTCAGGCATTTTCTCAGACAGGTTTTCGGGAGTCCGTATCATGTCACAGAGAAGCGTACAAGCTTAGGAATCTTGTTTTCTGAATTCGAATCGCAGGTTGCCAGTTACACCTGTATGCGACTCAACAAGTACTTTAACCTGTCTCTTAGCTGTTATACTACAAACCTCAGGCTTGTTAAGAGAAATGCTCCGCAAGGAACTAAACACAGAAGGTTCTAACGCTGAGCCAAGACTGGGAAACGAACTCTGGGAACTCACCCCAGGCTCCCCAAGAACATCGCCCCTCTGGCTGGAGCGCAATTGGTGATTGGCTACTTAACCCGTCCGTCCTTTCCCGCCCAGGGGTCCAATCCAATCCAGCCCGGCTCCGCTCGGAGACAGTTCGCCGAGTGGGCGGTGTCTATGACGTTTTCTGA | 0.00160589 | 0.009852004 | 4.57E-06 |
| 1363 | 3112879 | 5 | EXT1 | TAGGGTCTTGGGGTATCAATGTCTCCCACTCCATTTCCTGCTCATCTTCCAGGACTGGTCTAGTTTCCCATTCACACACCTCTGTGGCTCCTCCCTGGTTACCTAATTCTTGACTCTGTCAATTTAAGGAGCAGCAGATAAGGCTTAGTAACTTACTATTGATGTTTTGGATCCATGAGCATCAGCTAAGGCCTGCTGGAAAGCTTCAGGCAACGCACAGAGCACAGCAGCTCACCAGGACTGACCCTCACACTGGGCCCGGTGGTGTGCACTCCACCAGCACTAACTCGTCATGTCTCTCATCAAAAAATTTGGCATGTCCACTGTGCCAACAAAGTCCTG | 0.027405312 | 0.009431374 | 7.50E-06 |
| 858 | 3113688 | 3 | HAS2-AS1 | CCCGTTCATCGGCTGGGCGCTCGAGACGGCGCCCCCAGATCTCCCACCGGGCAGTGTCC | 0.000219649 | 0.012595807 | 9.78E-06 |
| 1062 | 3114046 | 3 | RP11-557C18.3 | GCCCAATTCTGCACTGAAGGACAAGGACTGCTGCAAAAGAAATGAGTGAGACCCTCAAAATAAATGAAAGGCACACAGCTCAGCCACTAAGGAGATGGACAAGCCATGTCAACCTCTGATCTGCTACTTTTTGCATCTATAAAAATGGTAACACTGCTACTTATACCTCAGGATGTTGTGAGGATTAAAAATTGAGTAAGCTAAGTGCCTGGTGCAGTCCTGGCACAGTCACTAAGCATTTACTATCTTTATGCAGTTTCTTTTTGTAATGCTAACTGCCCTCCAAATTCCTCCAAAGTAAACACATGGATTAGTAAATGAGAAAGAAACAATGCTTAAAACAACTATGGGTAACATACCTGTTTCAAGTCGCGTAGAATA | 1.20E-05 | 0.011270582 | 7.70E-06 |
| 1476 | 3114081 | 9 | WDR67 | GCAGACTTGTAAACTTCTCTTTGAGATTGGGAGCCTCGATGAAGGAATTAGCTCATCAGCAATTAGCCCACATGGACGGTACATTGCATCTA | 0.000280435 | 0.013530226 | 1.04E-05 |
| 633 | 3114092 | 9 | WDR67 | ATGGAGACCACGCCTACTGACATTCATCC | 8.88E-05 | 0.013744083 | 7.95E-06 |
| 1909 | 3114096 | 9 | WDR67 | TATATATGAGAGATCGAGAAATTGCTGCCACAGCCAGAGACCTAGAAATGAGACAGCTGGAACTCGAATCACAAAAGAGAC | 0.000862602 | 0.008984675 | 8.61E-06 |
| 1551 | 3114703 | 5 | MTSS1 | AGCACGCCATTAATTGCTGATGCTTGAGTACAGAAAGAAGAGAAAGAATAGGATTCCCTTTAGGCCCACGGTTTGAGTTACATTAAGCCTGTGGTCATTTCCTTTAAGACCTGGGAACATGGGCATTGCTCATTTTCATGTACTATT | 0.002997998 | 0.0115069 | 6.12E-06 |
| 1708 | 3114847 | 9 | SQLE | GCAAAGTTTATTGAAGGTGTTGTGTTACAGTTAT | 0.001236387 | 0.009381479 | 7.07E-06 |
| 1837 | 3115587 | 3 | PVT1 | GACTTCGCAGGTGAGCAGTAACGGAAATCAGCCCCGTTTATTCCTCCCAGCACCTGCCTTATCCAACTCCCCACGCTGTGGCTGAGTCCCAGCCTGCTATGGAAGCATCACTGGACTCCCATTGAACTCTGTGCAGATTCG | 0.000212296 | 0.007279185 | 1.96E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1661 | 3115998 | 4 | RP11-47304.5 | CTGTTCGTAGACATGGTACCTGATGGAC ACCAAGCTACGTACAGCTTC GCACACATCACAGCTTTTAACGTTAGTT AATAAAGGTTAAACACACAACATACATC CTTACAAAAAAAGTCAAAATGCAAACTT AAAACTTTAAACAAAAGTATTACTAATT TAAAAAAAGTTTGTGTTGGGTACCATTT GTACAACACAGTTAATTTAAACATTTTC ATTTTGGTTGCACATGAAAAAGGCGGCA GTAGAAAATAAAGTCATTGAGGGTTTTT AAATAGCAGAATAGGCAGTTTTGCCATG CAGGAGAAGCAATATTAAATATTAGTTT CAAAAAAAATCCACATTTAAAAATATTT AGTTCAAGTCACAGAATTTTTCTCAGTA GAGACCCCAATGCAATGCATAATTAGCT GCCTTAGATGGCCCGTTTGAAAGGATGA TATCCCTTCAGAGTGTAACTTTACTGATT TTGGCACAGAAAAGAAGTCTTAAGAACA TGATTAAAAAAGAGGGAAGAGGAACAG AGGAAAGAAATAAAAGCAAGAATAAAT GAGATAGTAATTGCAATCACTAAAAAAC TGCATTCTCAGTCATTGCAGAATACTGTC TTCTGTCTACAGCAGGTGCTTATT | 0.000553994 | 0.011864556 | 1.23E-05 |
| 411 | 3117908 | 6 | | CAGGAACAAATGCACCAGGAAAGGCAA TGTGACCAGGTGGGCAGCTGCATCCAGA ACCTGAGATTCAGAGTGGAGGATGCCAC CCTCATGTCCCTGATGATGCTTTCGTGG AAGAGTGGGGGCCTGGCACTAGAATGTG TTCACTAATG | 0.002991379 | 0.011194815 | 2.75E-06 |
| 339 | 3118152 | 1 | | CCGCGCTGTGGGCTACGTCTGAGCCGTC AGGTCCTCGCTGGGTCTGCGGGCGCCCT GGGGCGAGGGAGCGGGGAGCCCTACCC CGAGCAGGCACTCTCCCCAGATTCATTTT GGAAACCAAGGCCCCCGCGCTCGGCAAG TGAGCCTGGCT | 0.010386073 | 0.011188769 | 6.80E-06 |
| 1168 | 3118707 | 3 | DENND3 | CCCGGGGCCCATAGCCCACACCGTGCCC TGCGTTTCA | 0.001965656 | 0.007321616 | 4.60E-06 |
| 185 | 3119251 | 2 | C8orf55 | AGAGTCCTGCCTGGCCCTACGATGAGGC CACTCATGTGGGCCTAGGTAGGGAGGA TGGTGCCTGGAGCAGAGGGACCCACAAG TGCCTCCCGAGCCTAGATCCTGGCTCGG ACCACTGCAAGGGCCGAGGCAGGGCCA GACCAGAGCATCCTGGGTACAGGCCTGG GCTCTCCAGGGCCTGGGCCTGATTCAGG TGCAGTGGGCACTCCTGAAGGGTCAGAG CGGCATCTGCCAGGCAGCCCCTCTGGCT TCCGCTGAGGTGGTTGCAGGCCTGGGGC AGAGCCTGGGTGGTCAGAGGCCGGGGCT AGAGGCAGATGGAAGGGAGGCATTTGCT GACAGAGGACGGGGCACCCGGGCTCCCC ACTGCAGTCGGCCTTGCCTCCTCCTCCTC CTCTACCTCCAGTCAGGCTGGACGGGAG GGTAGCCTTGTGGCTGAGAGGGGTCAGA CTAGGTGGCACAGGGGCTCCTGGAAAGA CAGCAGGCTTCCTGCTGGGCGTTCCCTTG TTGGAGGGAATAGAGTGGGGGTGGGACT CTGCAGGGGTGTCCTTGTCCACTCGCAC CCCTCGCCGCCCACCAGGGCCATGCTCT GTGACTTGGGCTGATCCCCACCCTTTCTG GGCCTACAGCACCACAGGCCGCTGTACC CCCTTAGAGCTGCCCCTCTCTGGCCTGGC CGGCAGGCGTCTTCTTAACTCCT | 1.42E-05 | 0.015914535 | 1.24E-05 |
| 137 | 3119919 | 7 | EPPK1 | CACTGCAACAAGAGTACCCGATGGCATG ATGGACTGAGAGTCTAAAGAGTGACATT CTGTAAAATGGAAGCAGTGAATCCAAAA CAGACAGAAAATGTTCTGAAAACGAA AAAGGAGAGAAAAGTAAAACCATATGA CACATAGACGACCCAGAAAACACACCA AAAACTTATGAAACACCTCGATGGACA AAGGAAAAGTTTCTGTCACATGACAACT | 4.35E-06 | 0.028826853 | 2.57E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 560 | 3119979 | 9 | SPATC1 | TAAAACGTTTTCCACAGATAACGAATGGGTACCCAGAGCCTCTCAGCATGGCGTTTGCAGGAGCACCCTCCAGACCTCCACCCCTATCGGAGCCATGGGCACACCTGCTCCCAAGACGGCCTTCTCCTTCAACACTT | 0.0060277 | 0.013334373 | 1.31E-05 |
| 1300 | 3120764 | 5 | ARHGAP39 | CAGAGACACCCAAGACGAGCTCGGAGGCCTCCCACGACTCTGCCTCTGGTGTG | 0.000122727 | 0.010438117 | 4.98E-06 |
| 806 | 3124365 | 2 | AF131216.2 | AGCTCCTCCGTATTGTCCTGCCGGGAGGACAGGATCAAGTGGTGGCCCGTCAGGCACAGGGTGCCCTCGACAGCCGGGTAGAAAGGCCGGTGCAGCACCACATTGTCCACCCGCGGGGTCTTAATCAGCTCCGCAAACTCCATGCT | 1.77E-05 | 0.01362045 | 1.26E-05 |
| 1947 | 3124528 | 5 | FDFT1 | CTCTCGGCTTTTGGGTGATGCCACACAACTTGCAGGCGGCATATGCCCGTAGATTTACTGATATGCACCTAAAAATTCAGTGTAAATCAAGTTTACTAAACCCTGAAATTCTATAGCCAAATGCTTCTGTGATAGAAATAATCAGCCCTCAGTATCTGCTAAGCGTAAATTTTTTCCCTAGTTTGCAGAGAGAAACTGGTTGGGTGCAGTGGCTCACACCTGTAATCCCAGCACTTTGAAGGCTGAGGTGGGAAAATCGCTTGAGCTCAGGAGTTCAAGACCAGCCTGGGCAATGCAGCGAGACATTGTGTCTACAAAAAAATTTAAAAATTAGCCATGCATTGGTGACACGTGCCTGGAGTCCCAGCTACTCGGGATCAGGAAGCCGAGGTGGGAGGATGGCTTCAGCCAAGGAAGTCAAAACTGGAGTGAGTCATGTTCAGGCCACA | 0.023281585 | 0.007309709 | 5.45E-06 |
| 848 | 3125600 | 9 | MSR1 | GTCTTAAAGGTGATCGGGGAGCAATTGGCTTTCCTGGAAGTCGAGGACTCCAG | 0.000181274 | 0.017085539 | 1.35E-05 |
| 929 | 3127573 | 1 |  | GAGGGATACGGGGAGCCTCCATCTTTGGATTCTTTTGGTACAGGAACAACATCCCTCCAGGTGACCTCCACCTACCATGGCTCTGTAGCGCCAGCTCCTCA | 0.048959505 | 0.007288313 | 3.51E-06 |
| 664 | 3129039 | 9 | CHRNA2 | GAACCAAATGATGACCACCAACGTCTGGCTAAAA | 0.002388272 | 0.011092138 | 6.33E-06 |
| 1458 | 3129619 | 4 | KIF13B | ACTTGGCGTCAACATAATGCTGGAAACACTTACATCTCCAGGCTTCAGTGCAACTTCTTCGCCTGACTTCCCTTCCCTCGGTCCGCGATCCACTCCTGGGACT | 0.001135581 | 0.00738277 | 4.70E-06 |
| 386 | 3132919 | 1 |  | GGGAGCCGTGGTGTTGGAAGCAGCATGGGGAGGCTGCTTCTCTTCCCAAGTCCAGCAGCCTGCAGCCTCCTTCCCTCCGCCAGCCCAGAAGGCATGTGTTCCAAAGCCCCTCATTAGGCCTCTCTTAGCAAGCAAAC | 0.005684569 | 0.01383766 | 1.03E-05 |
| 2042 | 3134154 | 9 | PRKDC | AGAAGAGTCTCTGGTGGAACAGTTTGTGTTTGAAGCCTTGGTGATATACATGGAGAGTCTGGCCTTAGCACAT | 7.26E-05 | 0.00675565 | 4.66E-06 |
| 1629 | 3135385 | 1 |  | ATAGGAGACCTCATTCCTACAAATAATAAAAAAAATTAGCCAGCTCTGGTGGCGTGTGCTTATTGGTCTCAGCTACTTGGGAGGCTGAGGTGGGAGGACTGCTTGAGCCCAGAAGATCGCAGCTGCATTGAGCCAT | 0.002024742 | 0.008228586 | 4.97E-06 |
| 902 | 3135419 | 1 |  | CACACGTGTGGTAGGATGCAGAGTGCTCTGGGCAGGCCACTCAGAGGCCCAGGTCTGCTCCATGGTCCCAG | 0.002543079 | 0.009783809 | 9.62E-06 |
| 2052 | 3138424 | 2 | ARMC1 | TCTTTTCATCAACATGTAGAGCTGCTATTTTACTATTTGGAGAATATGATGTGAAAATTGGACCTCAAAGGGTTTCCTTGTGTTTTCATTGTAAAATACCATCATCAGTGAGAGTCTTGAGTTCACTAACATTGTCACCTTCTGGAGAGAGAGTTAATGGGGGCATTGAGGATGATATTTTTTACATGTGTTTGGTTTCTGATTCAAGTGACACGCACAAACTGAAAAAAAAAAAACAAAAAAAGCAACAATAACTTTCAGGGCACCTATTGCTCTAAATGCATAATATAACTTGCTGCCAGAACCAGATGTGTTTAAAAAAGAAAATAAAACCAC | 3.35E-05 | 0.009405851 | 3.32E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CTTCTTTCTATAGCCATTAAAGCAAACTT TACTGTTCTAACAAATTTGTATTTTATTT TGCATTGCCACACATCTGCTTATTTAAAA ACTACATCCCTTTGGTAGTAATGTTTCAG GACAAGTAGGTATTACAGC | | | |
| 1488 | 3138480 | 9 | PDE7A | TGGGTGTGAGTCCACTTTGCGATCGTCA CACTGAATCTATTGCCAACATCCAG | 0.01575619 | 0.011220854 | 1.37E-05 |
| 1971 | 3138675 | 7 | RRS1; ADHFE1 | ACTCCCGCTCTGATACACAAACTTGTTGT AAAATAATGCAGAAACATATACGTCAA TCTAAGTCTCTGAAATATGGCCAACTCT ACCTCGCCGTATATCCAACATTAAAAAG AAAAAAAAGGCTGTTTAAGAATAGAA CTCATTCCCGGTTTCCACCAAATTATTTC CCTAATTCTTAAATCCTCAAATAAGTTCT TAATCTCCAAAGTCTCGGTTGTGGGAAA AACATTAATTTGTGCAGTCCAACACTTA CATACTTTCTTGACGGAAGGGCAATCCT GTCCCTTTAAACTCAATGAAGGCAGCGG CC | 0.006898401 | 0.006687195 | 5.87E-06 |
| 1983 | 3138814 | 9 | VCPIP1 | TCAGGTTCGAGCAGAGGCTACTACAAGA AGTAGGGAATCAAGTCCCTCACATGGGC TATTAAAACTAGGTAGTGGTGGAGTAGT GAAAAAGAAATCTGAGCAACTTCATAAC GTAACTGCCTTTCAGGGAAAAGGGCATT CTTTAGGAACTGCATCTGGTAACCCACA CCTTGATCCAAGAGCTAGGGAAACTTCA GTTGTAAGAAAGCATAATACAGGGACAG ACTTTAGTAATAGTTCCACTAAAACAGA GCCTTCTGTATTCACAGCTTCTTCTAGTA ATAGTGAGCTTATTCGAATAGCTCCTGG AGTAGTAACAATGAGAGACGGCAGGCA GCTTGATCCTGATTTGGTTGAGGCCCAG CGAAAAAAATTGCAGGAAATGGTTTCTT CTATTCAGGCTTCAATGGACAGGCACCT TCGGGATCAAAGTA | 5.66E-05 | 0.007953518 | 1.54E-06 |
| 2063 | 3139046 | 2 | ARFGEF1 | CTGAGATACTGGTAATCATCCTGTGAAA AATGTACAGAGATGCAGGTCTGTAATAT AAAAATCTTAAAACATTATATAGTTCTTC CTGCACTGTTTTCTTTATTTTCTTATTCAT TTGCTAAATACCCATAATATTTTGTCAAA TGCACTAAACATTTGGGTGGAACTTTCTT TTTTATTTTATAGGGATTTTTAGTTTTGC CCTTTTTGGTAGGTGGTGATTTTGAGGCT GTAACATGCCCAGAAGCTGTTGTGGCCG ACACTTCAACAATAGGGAAAAAAAGGT AGAAAATATCCCTACTGACAGTAACTAC CTGTCACATATTTCTCTTAGGACTTTTAA AGATGAGCCATTAAAATAGAATGATCCT TTATGGACCAAAACTTGAATCACTGC | 0.000629941 | 0.007275746 | 6.32E-06 |
| 984 | 3139077 | 4 | ARFGEF1 | ATGTTCAGATTAGGGTAGATTCCAGTT GTTAAAGAGGTTGTGTGTGTTCTAGTTA GTAAAGGAGAGAGAAAAGATCAGTAAA CTTTGTTCAGTGATGGCCTTTGATTTTCC TACCTCATCCCAGGATATGTATGGG | 0.001852254 | 0.008893133 | 6.29E-06 |
| 119 | 3139107 | 9 | ARFGEF1 | TTAGAATGCTTAGTGTCGATTTTGAAGTG TATGGTTGAATGGAGTAAGGATCAGTAT GTGAATC | 6.61E-08 | 0.033566027 | 3.81E-05 |
| 1079 | 3139108 | 9 | ARFGEF1 | CTATGACTGTGACTTAAATGCAGCCAAT ATATTTGAAAGACTAGTAAATGATCTAT CAAAAATTGCTCAAGGAAGGGGCAGTCA AGAACTTGGTATGAGTA | 1.18E-05 | 0.015040305 | 6.57E-06 |
| 265 | 3139551 | 5 | SULF1 | CGGATGTTTTTTCGTTCCTGCTGTATCCG TCCTCTGAACCTCGGGGATCTGACAGTC GAACAGAGGCTTCCCAGCAATTCTGTGC CCAGG | 2.63E-05 | 0.021575493 | 2.25E-05 |
| 1236 | 3139562 | 7 | SULF1 | TTAGCAAGTCGAGGTAAAACACATGCAA CATTTTCTGGCAAAAGCTTAATGTCAAA CAATATGTGATCCATACTGTGTGTCGTCC TTGGGGGTTTATTTGACTTTGTCACAATG ACAGCCAACAGTGAGACTGATAAGCCTG | 2.88E-05 | 0.01622433 | 1.99E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TAAAAATAAAAAAATAAGACTAATCAA ATAGACATGGCATTTTAATCTCAAAGTG CAAAATCATCTAACTGAAAATGACGGCA TTGAAAAATTCCAGTGGTTAAAAATGAA TCAAAACTTCATTACGCAGGCAGTGGAA GTGTGTTGAAAGATTTACCAGGGGTGTC AAGTTTTAGACACTCAGAAAGGCACCAT TCTAGCCATCTTGATTG | | | |
| 1337 | 3139607 | 9 | SLCO5A1 | CTGAGAGTGCCATTGTAACTGCTTTCATT ACCTTCATTCCCAAGTTCATCGAGTCACA GTTTGGTATCCCAGCCTCCAATGCCAGC ATC | 0.01612054 | 0.00752669 | 5.63E-06 |
| 186 | 3139630 | 9 | SLCO5A1 | TCTGGGTACCTGAGCAGCGTAATTACCA CCATTGAAAGGCGCTACAGTCTGAAGAG TTCCGAGTCGGGGCTGCTGGTCAGCTGC TTTGACATCGGGAACCTGGTGGTGGTGG TGTTCGTCAGCTACTTCGGCGGCCGGGG TCGGCGGCCCCTGTGGCTGGCCGTGGGT GGACTCCTCATCGCCTTCGGGGCAGCCC TCTTCGCCTTACCTCACTTCATCTCGCCC CCCTACCAGATCCAAGAGTTGAACGCCT CGGCCCCCAACGACGGCCTGTGTCAGGG TGGCAACTCCACCGCCACTTTGGAGCCT CCGGCCTGTCCGAAGGACTCGGGAGGAA ATAATCACTGGGTCTACGTGGCTTTATTC ATTTGCGCGCAGATTCTCATTGGAATGG GCTCCACACCTATTTATACCCTGGGACC AACCTACTTAGATGA | 0.000367918 | 0.011111055 | 1.14E-05 |
| 1706 | 3139726 | 2 | NCOA2 | TTGCTTCTTCAGCTGACCGGGCTCACTTG CTCAAAACACTTCCAGTCTGGGAGAGCTG TGTCTATTTGTTTCAACCCAACTGACCTG CCAGCCGGTTCTGCTAGAGCAGACAGGC CTGGCCCTGGTTCCCAGGGTGGCGTCCA CTCGGCTGTGGCAGGAGGAGCTGCCTCT TCTCTTGACAGTCTGAAGCTCGCATCCA GACAGTCGCTCAGTCTGTTCACTGCATTC ACCTTAGTGCAACTTAGATCTCTCCTGCA AAAGTAAATGTTGACAGGCAAATTTCAT ACCCATGTCAGATTGAATGTATTTAAAT GTATGTATTTAAGGAGAACCATGCTCTT GTTCTGTTCCTGTTCGGTTCCAGACACTG GTTTCTTGCTTTGTTTTCCCTGGCTAACA GTCTAGTGCAAAAGATTAAGATTTTATC TGGGGGAAAGAAAAGAATTTTTTAAAAA ATTAAACTAAAGATGTTTTAAGCTAAAG CCTGAATTTGGGATGGAAGCAGGACAGA CACCGTGGACAGCGCTGTATTTACAGAC ACACCCAGTGCGTGAAGACCAACAAAGT | 3.46E-05 | 0.009051694 | 5.98E-06 |
| 1822 | 3139788 | 9 | NCOA2 | AAGAAAGCGCAAGGAATGTCCTGACCA ACTTGG | 1.08E-05 | 0.008651908 | 6.79E-06 |
| 820 | 3139840 | 4 | NCOA2 | TCAGACTGTGGCTTAATATACAATAATTT TCTCAGAAAAATGAAGCTCTTGCGAAGA ATGGTTGGGCATATTTCACCAAAATCAA GTATTTGTGTGTGTGTTTTTTTTTTTGGA GTTTGAATATAATCCTGTAAGTAGATGC TTCAAAACCACTTGAATCACCATGGAAA GCAAATCTCTTTAGTTATTCTCCATCTAA GCAGCCTTTGCCGTACAGTTTAATT | 6.21E-05 | 0.016208818 | 1.23E-05 |
| 256 | 3139841 | 4 | NCOA2 | CATCTCTTTTAAGGTGGACCAGTTCCCGT GGTTTGTTTTGTTTGTTTAGACTTTTTAG AGTCTAAGCCAGTTGTTCCTGAAGAGGAT GCAATTGTTCTATCAATTTTGGGGTGTCA GACTTCAGTTTCTCCAGAACTGTTAGGA AATTAAGTTGTTAATGTGTTACTGAGTTT GATCAGGGCTGAAGAAGCACAGCCAAC CTTTGAGAGCTTATTGCTTGAAATGATG GCATCCTTGGACCTTTTCATGGCATGTTC CTTCTGAAGTCTCTAGGTCTGGGCC | 1.77E-05 | 0.014482929 | 1.28E-05 |
| 1585 | 3139843 | 3 | NCOA2 | TGGCATATGCTGTAGTGATCATGTCCTG GACCTC | 0.004639335 | 0.007233204 | 3.77E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1969 | 3139907 | 2 | TRAM1 | GTTCTTGAAAATACAGTCTGTGCTCTTTG ATTTTTGCTATTGTACGGTTTCATGCATT TTTTTAAAGGGCATTTGAGGGGAGGATT ATTGCTATGAATGAAAAAAATATTTTAG CTTAGACTAAGCTACCTGCCTTCAAAT AGTTTAGGGACCACCACCATATTTTATTT TGTTTTTATTTTTGAACATTTTTCTAATG ATTTGGAGAGAAAACTATTTACAAAAAT TCCACATATCAGTGATACAATTTCTTGCT GTCACCAATTTTTTATAATAGCAGAGTG GCCTGTTCTAAGAAGGCCATATTTTTTAA GTTATCTTTCAGGGTAACATGGAAATAC TATAAAGTTGGATGTCAAACTTTAATAT GTTTTCAGTGTTCTCTAATTTTTTGGAAT TTTTGTAGACTTTACACCTGGAAAAAAA GATTTGTAAAATCACCGGAACAATTGTG TGCTTTATTTTATAGGTAGTGGTTATTAG TATTACATCCCCATTTTAAAAACAAAAA CATAATAATCGTTACAACACGTGGAGTT TTACTAACATA | 6.51E-05 | 0.008461955 | 5.00E-06 |
| 1944 | 3139925 | 9 | TRAM1 | GAAAACTACATCTCAGACCCAACTATCT TATGGAGGGCTTATCCCCATAACCTGAT GA | 0.002671169 | 0.007740888 | 7.55E-06 |
| 2001 | 3139926 | 9 | TRAM1 | AATTAACAGGCGAATGCACTTCTCCAAA ACAAAACACAGCAAGTTTAATGAATCTG GTCAGCTTAGTGCGTTCTACCTTTTTGCC | 1.31E-05 | 0.008848099 | 5.28E-06 |
| 447 | 3140775 | 2 | UBE2W | CCAGGTCCTCATGTATTGTGCAATAACA ATGACTTCCTTGGCGGTTTTGGTACGTTC ATTGCCGGCAATGGGCGTTGTAACAGGA AAAGTTTTCATTAACTCCTGCCATTCAAT GATTAATGCATGATAGGGCCTATGAAAT GAACTTACTGGTTATAGTGGGAATATAA ATAAAGTGAGGGATCCAACATTACTTTA AAAGTCACCCCAACTGTTTATATTTGGAT TCTATGCACTGTGATCCTAAGGTTAACA GCATGAATTAACATGCGTCTTTAAAGGA CTGTAATGAAAGATCATTGCATATTTATT GAATTGTTTATATCTACTGTCAAGTTGTT TTGACATGGAAGATTTTCAAGTAACATT GGCAGAGAGGTACAGTATGTTATCCCTA TGGTG | 0.001052466 | 0.017989974 | 1.81E-05 |
| 1526 | 3140795 | 4 | UBE2W | CTTCTCCAGTACATATGCCACATTGTTGT CAGCATGATCATATTTTATTTAAAAATA CTTTACATATGTTTATTGCCAAATATTAG AAAATACAGATTCATGGAAAGAAAAATC ACTGTCCCAAGGAGATCACTGCATGGTG AGATTAAGGGGTGATTTTAATTTTTAAA AATGTATATTTTTTCCTGTGTAGAGTAGT AACACCCATTGAAAACACAATCCCTTGT AAAGTCTCTAATTCTGTACTCCGCATCTA GCTGATCTCTTCTTTCTCAGATATTTTAC AATTTCATTTATCACCACCTTTCTCTAGC CTTTACCCGTCTCTTCAATATTTACATAT GCAGAAGTTTCTCCTAACAAACACCTGC CTCTGCCTCAGTTCTGCTACCACCCTGTT GCTTTC | 0.005613406 | 0.009006123 | 6.57E-06 |
| 1830 | 3141853 | 4 | MRPS28 | GTCATCTATCCGAAGGCATTTTGTAATTG TGCTTGTGTGTGTGTGTATATGTGTGTGT TTGTGTTACAGTTTAAAATCTTACTGTAT TACCTACATCATTGAAAGAATCATCATG CAGCCTTTCTCAACAAAGGCTTATCTAG AGAATTATACCCTAATATCCTAAAGTAT ATTTAATGAATTAATAAATATTTAATGA ATTAACTTACTCATTCCTGGGAGAATTG AGAATAGAGTCATTCAAATCATTTTCTAT GGGGTTAAATTCTTTGGCTGAACCCGAG TTGAGAAAGGCTGCTAGAGAATGCATTG AAGACC | 0.003636318 | 0.00677358 | 3.50E-06 |
| 1663 | 3141865 | 2 | TPD52 | ATGATACTGTAGAACCTGTCTCCTACTTT GAAAACTGAATGTCAGGGCTGAGTGAAT | 0.000637737 | 0.011384196 | 1.16E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CAAAGTGTCTAGACATATTTGCATAGAG GCCAAGGTATTCTATTCTAATAACTGCTT ACTCAACACTACCACCTTTTCCTTATACT GTATATGATTATGGCCTACAATGTTGTA | | | |
| 1959 | 3141883 | 9 | TPD52 | ATGTTGCTGCCACGATCAGTGCCACAGA G | 4.84E-05 | 0.007772796 | 7.02E-06 |
| 1920 | 3141894 | 4 | TPD52 | CATTTCAGGTAGAGCGTGTCACATGGAT GTAAATACCAAAGGTCAAGGACATGGGC TTGAGAGATGGTGAGAAGGATGGAGGT GACTGTGGCTTGCATTCTATCCGTATCAC TATTAATTACCTTCTAATGCCTTTGGCTC TAGGTGGTGGAACAAGTAAAGTAATGGA CAAATACTTTTTCTACCAATATTTAGTGA CCAAATGCAGAGTTATGGAGAGGGCCAG GGACCTCATGAACCATACTC | 0.000961152 | 0.007445917 | 4.49E-06 |
| 638 | 3142136 | 2 | ZNF704 | CCTCAGGGATATACAGCGGAGTTTCATG ATAAACTACCCATACTTTCCCAAAAAAG GTTGAGGAGCAATACATAACTTTGCAGA TTACAAACCCTTGTTTTACTTTTTAAACC TTTTTTCCATACTCTGCTTATTGGAAATC GATGGCTGTGATGTGACCAACACCTGTG ATGATAGCAAAGCCCCTCCTTTCACAGT CTCCTGACTGTTCGGGGAACCTCCTTGGT CATTGGTAGAAAGCTTTAGAAAAGACTT AGCTTTTTAGGGAAGAACTAAAAAATCT CCAAAACATACTAGTCCCATGACTTCGA TAACTGAAAATGTCCTGGGTGTAAACTA ACCCAGGAATGTGGATCATACATGTTTT TTTTAAAAAAAATCCCTGAATCAATATTT TCCTACAACACACCCTAAAATTCCTATTT TTGTAATTAATGGTTGGACAGTGATCAG CCATTTAAACATAGGCTTTCTGGAATAA CCAGACACTAGAATAGTTTCCAAAGTGT TTTGCGTATCAAAATCCTATATACTTAGA AGAAGAACTCAGGATAAGAAAAAATCG CTAGGTCCCAAAGGGTTCATGACTATCA TCAGATGCAACTGCGAGTGGCCTACGGT CATTTTTTCAAATGAGAAGACTGGAGAG AGAGAACAACAGTAATCACAAAACCTCT GTTGCCCTTAGTCCATGACAATGTTTAAG GAAACTTTAAAAAATTAAGCCATCTTCT GAATTGTTTTCTACACCAAATCTAAAAT ATTAAAATGAAATTATTAAATATTTAAA ATGGGGTATTTAGTGGAAATGCAATCAG TAGAAAACATTGCTTTTTAGTGCCTGCTA AACAAGTAAAGGAGAAAGAATGAAGAG AAAACAGCAGTCCTTCCTGTGTGACACT CGTGTGGAAATGACAGGCATTCACATGT CATTGAGTGCTAACTCAAAAGCTAGGTG GCAATGCTGTCCAATGTTTA | 0.025498894 | 0.012518258 | 1.63E-05 |
| 1838 | 3142146 | 2 | ZNF704 | AACAGGATGTAGAAAGACCCATGAAGA AAGAAAGAAGAAAGCTATGGTTCCGAA AGCAG | 6.13E-05 | 0.006851634 | 5.15E-06 |
| 1460 | 3142170 | 2 | ZNF704 | TTTCATAGTGACTGACAGGACATTCTCC AGAGAGCGACAAAGCAGAGTGGCCAGC AGGCAGTGGTGTTAAGCCTTGGGCCTTC | 0.000357766 | 0.009437061 | 6.74E-06 |
| 716 | 3142182 | 9 | ZNF704 | AAAGTGTCGGAAGGTGTACGGGATGGA GAACCGAGACATGTGGTGTACCGCCTGC CGCTGGAAGAAGGCCTGCCAGAGGTTCC TCGACTGA | 0.002612225 | 0.011108751 | 5.96E-06 |
| 1022 | 3143340 | 4 | FAM82B | TGCCTTCACATCTGATATGTGTTTGTCTT TTTCTCCGAATTTTTTTCCTGATTTTAGCC AGTCATTCACATCTGCATTTTGTTTGTCC AGTTCTGAGTTTTTAAGTTGCTATTTCAG ATTTTTTAAATATCTAATAATTTAATTCA TATTAGCATATTGTGTTAAAGTTACTCT CCTTTTTCTCATTTTCAATTTCTCTTTAGA GTGACTTATTTTTTTTTCCCTAGGGATGT AATTTTATGTTGAGTTACCAGCAATACTA | 5.59E-05 | 0.01435305 | 9.55E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 325 | 3143470 | 4 | CNGB3 | GGTCATCAAATGGGAAGAAAGGGTCTGG GTTAGTTCAAGAATAT AGTCCCAAGTTGAGTGCATGCTGTTTTGT AAACCACAGTGTCTAAACTGTAGCAAAA ATCAGATGCATAGACAGGTTATTTTTAC CTTGCAGAAAAGCACTGTATACAGAGTT ACAGGAACAAATTTGATATCATATAATT TAAGAAGCTCTCATAATCAGGTATGGAC ATTGGCTTATACAACATACACTGTGAAT CAGGCACAGCAACCTGCAAACCACATCA TCCCAACAGTTTTCCATTCTTCCTATTGA CAAACACTTAAACACAGCATTTTCATCA TATGAAAGTAAACAAAAACAACAACAG AATAAGCTTTCCCCACACTAATTTCTAAT CCAAAGAGCTTTACTGCAATTAATGTAA ATTGCTATCAATCACTGAATTGACTGGG CAAAGATGGACTTGGCACTGTCCC | 2.71E-05 | 0.017979346 | 2.25E-05 |
| 1584 | 3143922 | 4 | RP11-37B2.1 | ATAATGTTGGTGACTCTGTGAAGGATAT TAGAGGAGGCAAGAAGACCATTGATGA GGTTCCTGCAATAGGTCATTTGA | 3.87E-05 | 0.007023854 | 5.38E-06 |
| 2036 | 3144771 | 9 | RBM12B | CGGGGCCTGTGGATATTCGTCACTTCTTC ACGGGATTGACTATTCCTGATGGAGGAG TGCATATAATTGGAGGGGAAATTGGGGA GGCTTTTATTATTTTTGCAACAGATGAAG ATGCAAGACGTGCCATAAGTCGTTCAGG AGGGTTTATCAAGGATTCATCTGTAGAG CTCTTTCTTAGTAGCAAGGCAGAAATGC AGAAGACTATAGAAATGAAAAGAACTG ATCGTGTAGGAAGAGGGCGTCCAGGATC TGGGACATCAGGGGTTGACAGCCTGTCT AATTTTATTGAGTCTGTTAAGGAAGAAG CAAGTAATTCTGGATATGGCTCTTCAATT AATCAAGATGCTGGGTTTCATACTAATG GTACAGGACATGGTAATTTAAGGCCAAG AAAGACAAGGCCATTGAAGGCCGAGAA TCCTTACTTGTTTCTACGAGGTTTGCCTT ACCTAGTAAATGAAGATGATGTACGTGT CTTTTTCTCTGGTTTGTGCGTGGATGGAG TAATTTTCTTAAAACATCATGATGGCCG AAATAATGGTGATGCCATAGTAAAATTT GCTTCATGTGTTGATGCTTCAGGAGGTCT TAAATGTCATAGAAGTTTTATGGGTTCA AGATTTATAGAAGTAATGCAAGGATCAG AACAACAGTGGATTGAGTTTGGTGGTAA TGCAGTTAAGGAGGGTGACGTTCTTAGG AGATCTGAAGAACATTCTCCACCAAGAG GAATTAATGATAGACATTTTCGAAAACG GTCTCATTCAAAATCTCCCAGAAGAACA CGTTCTCGTTCCCCTCTTGGATTTTATGT TCACTTAAAAAATCTGTCCCTCAGTATTG ACGAAAGAGATTTAAGAAATTTCTTTAG AGGTACTGATCTGACTGATGAACAGATT AGGTTTTTATATAAAGATGAAAATAGAA CAAGATATGCCTTTGTGATGTTCAAGAC TCTGAAAGACTATAATACCGCTCTGAGT TTACATAAGACTGTTTTACAATATCGTCC AGTTCATATTGATCCAATTTCTAGAAAA CAAATGCTGAAGTTCATTGCACGTTATG AAAAGAAGAGATCAGGGTCACTAGAGA GAGATAGGCCCGGACATGTTTCACAAAA ATA | 0.001852254 | 0.007359204 | 5.57E-06 |
| 1393 | 3145100 | 6 | | AGTACAATGCATACTCCTTAGGTTCTTAA ACTCTACCAGTCTAACAGAAAGCACCAA GATACAGATGCCAAAGTCAGAAAAAAT ACAAAGCAGCTCAGAATCAATATCATAT ATCTTATTCAAGGTAAATTTATGTTAGA TTCTTTGTCTGGCATTTGGGAGGCTAAAT TAACTTAGGAGGCTAGAGATCCCATCTC | 0.011131791 | 0.007702451 | 5.96E-06 |
| 777 | 3145187 | 5 | C8orf38 | TTTTGGAACCTATAGAACACAACAAAGA GAGAATTTTACTGCATGTACTTTTAAATA | 0.000468776 | 0.009489743 | 4.21E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AATTCATTCATTCATTCTTTAAGTAATTT TTAAAAAGAAGATTATTAGATTGTCTCC CTCACTCACTACTAAGAATGG | | | |
| 204 | 3145592 | 9 | MTERFD1 | ACTAGAGATCTGGTAGTTCGTCTCCCAA GGCTGCTAACTGGAAGTCTGGAACCCGT GAAAGAA | 2.95E-06 | 0.023094718 | 1.57E-05 |
| 454 | 3145807 | 2 | TSPYL5 | TGAGGACTGGGCCTATATAGAATCCAGA TACCATTGTCAACTTCCCTTATTCCCGTC TAAGATGTGAGCAGAGTGCCATAGTAGG GGTTCT | 0.001925692 | 0.011918826 | 6.99E-06 |
| 102 | 3145886 | 5 | MTDH | TTGGTTCCTGGGACTTTAGAAGTGAAGC TCTTTCTTCGTCTACCCAATTGCCCCACT CTTCTGCTGGTGCATTCCAATCAGAGTTG GGATCAGCAGAAGACAGACCATCTAAA ATTTAA | 3.41E-05 | 0.03013173 | 3.38E-05 |
| 130 | 3145888 | 7 | MTDH | TTTTATGGTGGTGTCCGCAGTTTTGTTTT AAAAATTGGTTTAAATTTATATAAAACT CTGTACATGTTCACAAATTATTGCATAA ACAGCATAATCTTCAAGACAAGTGTTTG CAAACACATGTCCAATTCAGGAA | 2.84E-05 | 0.027153197 | 2.73E-05 |
| 149 | 3145890 | 7 | MTDH | GTTTGCTCAATTGTCGGTACAGATAGGT AGGATTCCAGTCTGGAGAAACCCCTAAA CCACTACACCCTGCCTCAGAGTAGGGAA GAATTTTCAGTATGTATGTGGAGACAGG CTGGATTAGGGAGCCTTTTGAGTGGCTT C | 0.000101783 | 0.020297858 | 2.08E-05 |
| 1811 | 3145981 | 2 | HRSP12 | TGCTGTGTAGTCTGGAATTGTTAACATTT TAATTTTTACAATTGATGTAACATCTTAA TTAACCTTTTAATTTTCACAATTGATGAC AGTGTGAGTTTGATGAAAATATCTGAAG CTATTATGGAAATACCATGTAATAGGGA GAGTTGAACATGAATATTAGAGAAGGAA TCCAGTTACTTTTTTAAATTACACCTGTG TGCACCTGTATTACTGAATATAGGAAAG AGATACCCATTACATAGTTACTCAGTAA ACAAAAGAGAAATACCAGGTAGGAAAG AAGAGTTACTATTCCTGAGAAATAATCA AGAACATATTTAATTTAAACTAATGATG TGAACTATTTAGTTTTGATGTCCGTTATG TGATTCTGC | 4.53E-05 | 0.009789405 | 6.30E-06 |
| 1722 | 3146344 | 4 | RP11-410L14.2 | GACCTATTCCATACCTATCAGACTGACA ATATTTTAATGTATAATGTTAATGAGTG GCATGATAGGAACCTAGTGCACTGTTGC TGAGAACAACACAGTGGAGAGGAATTA AGCAATATCTAGCAGAGTTGAAGACGCA TATACCCTA | 2.08E-05 | 0.008830151 | 5.09E-06 |
| 1738 | 3146442 | 9 | COX6C | TTTCGTGTGGCTGATCAAAGAAAGAAGG CATACGCAGATTTCTACAGAAACTACGA TGTCATGAAAGATTTTGA | 0.000110135 | 0.010882068 | 6.38E-06 |
| 1244 | 3146529 | 9 | FBXO43 | ACTGATCGGCAAGAAAATGGGTATAGAA AAACTGGACATCTTAACAGAATTAAAAT ATAGAAATTTAAAGCATATTCTTGCTAT GGTTTTAGAGTCCTTGACCGCAGAGAGC CTATGCA | 0.003390971 | 0.011341658 | 9.24E-06 |
| 1215 | 3146566 | 2 | RNF19A | CATTATGGTGCTACTGAGCGTTTTCTTTT GGTAAAAGAAAAATGCCATGGGCTGC AGTCTTCTTCCATCACTTTTCCCTACCAG GTCCATTAATATGCTTATAACACTAGTGC CAGTTATTTTATTTGATAATGCTTATGGT ATTTGTATATTTGTTTGCATTCCAATTTT GTTTAATAATGAGTGTGTAAACTGCATA CGTTA | 0.000148906 | 0.010441166 | 1.00E-05 |
| 362 | 3146569 | 9 | RNF19A | CACCCGAAGTCATGCTGGCGGTTCATCC AGTGGCTTGCCTGAAGGTAAATCTAGTG CCACCAAGTGGTCCAAAGAAGCAACAGC AGGGAAAAAATCAAAAAGTGGTAAACT GAGGGAAAAAGGGTAACATGAAGATAAA TGAGACGAGAGAGGACATGGATGCACA GTTGTTAGAACAACAAAGCACGAACTCA AGTGAATTTGAGGCTCCATCCCTCAGTG | 0.00010545 | 0.021503954 | 1.92E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ACAGTATGCCTTCTGTAGCAGATTCTCAC TCTAGTCATTTTTCTGAATTTAGTTGTTC TGACCTAGAAAGCATGAAAACTTCTTGT AGTCATGGTTCCAGTGATTATCACACCC GCTTTGCTACTGTTAACATTCTTCCTGAG GTAGAAAATGACCGTC | | | |
| 2019 | 3146577 | 9 | RNF19A | TCGGTGTTCCTATTATGTTAGCTTATGTC TATGGCGTAGTTCCAATTTCTCTTTGTCG AAGCGGAGGTTGTGGAGTCTCAGCAGGC AATGGAAAAGGAGTTAGGATTGAATTTG ATGATGAAAATGATATAAATGTTGGTGG AACTAACACAGCTGTA | 0.000885779 | 0.006579631 | 3.15E-06 |
| 478 | 3146675 | 2 | ANKRD46 | TTTCTTAGCGCAAAGCAGTGAGGGCAGT ACATGTTCTTTTTGCATTTTAATTATTGT AATCCTTTTAGATAATGATGTGTTCATTT GAACTAACTACATACTATGATCAAGTAT ATTGCATCCTAACGCTACCTCTGACTCAA CCTGACTTTGTA | 3.35E-05 | 0.019301227 | 1.64E-05 |
| 1945 | 3146698 | 3 | ANKRD46 | AGTATGGAGTACTGAAGGCCAAGTAAAG AGTTTTTCAGGGAGAAAGTGACCAACTG TGTCTCCTCCTGCTGATTGACAAGTCAAG TAAGATGAAGACTAGGAGATGACCATTG GATTTAGTAATAGGAAGGTCCTTGGTGA CCTTGCAAGAGCACTTTCAGGAGAATAG TGAGGAAGAAAACCTGATTGGTGTGGTT TCAAGAGACAACAGGAGGAAGAGCATT GGAGACTGCAGTATGGACAGCTCTTTGG | 0.006376399 | 0.006617936 | 4.09E-06 |
| 639 | 3146904 | 6 | | TTTTCATGTAAATTAGTCTTGGTTCTGAA ACTTCTCTAAAGGAAATTGTACATTTTTT GAAATTTATTCCTTATTCCCTCTTGGCAG CTAATGGGCTCTTACCAAGTTTAAACAC AAAATTTATCATAACAAAAATACTACTA ATATAACTACTGTTTCCATGTC | 1.45E-05 | 0.020079582 | 2.10E-05 |
| 1126 | 3147061 | 2 | ZNF706 | TCCCTCCAGTTTGTCGCATTTAATCAAGG AGCGGTTGTAGCTGCCTACGATTTTGTA GAAAATTGTGTTGGCTTGAGAGCAAGTC CTAAGTTGAGCTGTCCAAAAGCAGGTGG TTGGTTCGTTTGAATTTCTGCTTTCAGAA AGGAAATCGATGGGCGTGTTGTCAGAA GTTAGGGGCCTACCTCATGCATTTAGCTT ATTTTATTCCATTTCCTTTACCTGGTGTT AAGTTTTCTGTCTTCAGAATAAGAACAA GTGACTACTGTCTTTATTAAGTCTCTTCG GTCTTTTTGGTTGCTGTTTGGTGACAATG GAAAATGGGTTGAATCTATTGTGTAATG TTATATTTTAGGGAAAGTCCTAAGTGCA AAAGTTAAAAATAATTTTGTGTGTCTAA TGACATTGCTTTGTACGAGTCACAACAT GGAAATATCAAAATAGCTAGTAACTTCT AGAAAGCAAAGGAACTTCTGAAATTAGT GGCTTACCATTTTTGAAGATTTTTTTTAA CATAAAACAAGATTTCCCACAAAATCAG TGTATTAAGATACATAAAATACATTGTG TCGAAGAGTTAAGATGTGTGAGAAGACT GGCTATTTTGTTACAAGGTCCTGATAGTA AGACATTGAGACAAAAAACCTTGCAAAA CATTGGTATACATAAAGGCTGATCACGT GACTACTGTCGTCCAAATAATACATAAG TATCCAAACCTGTTTCCATGGGAATAGG TTTTGTAAGCTTGCGGTAACATCGGACTT AAATACACTTTTAAAAAAAATGTGCCAT TTGGCTTAGAATTAATAATTTTTTTTAAA GCAAAATGGAAGCTTAGTCTTCAAGGA CTGATAACAGCTGGTAATATTTACCATT GTTTGGTGGGAATGGGGTTCTCATATTA GGCTAGCACGCTAAACATTTTCAATTAC GAAAATGTATTAGGCTCGTGTGCTACCC TAATATAAAAACCCCATATTTCCTCAGTT GAAATAGTCAGCTGACTATCCTGAAAAG CATTGACCCTCTTTTATATTTTATCTGAC | 0.002671169 | 0.009051504 | 4.43E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TTTCAGTTCATTTTTTTAATGCTAGTGGG AACTTCTCCAATCAGTGTATTTTTTTAGT TTCCTTTTTTGGGGAACAGGAGGAGCTC AGTAATTTTTATGAAATGCTTTGACCTCA TATCCATTAACTAATTATGGTCCTAGTCA GAAGAAGCTAGCACCCTTCCCTGGTGAA GTTGATACAAATCCATTGTATGTTCCTGT CCTGCAATGATTTACATTCAGTTACAGTA CTAGTCAAAACTATATATATATGAATTCT ACTTAGGATCCAATTTTGATATATTTAAA AAGCAATTGAGACTCATGATAGACTTTA TGAGCAGGTTTAACTTGTGTGGTCGAAT AAAAGCCTTTAATTTAAATGGAAAAGTA AAAGTAACTTTTTTCAGTGACTTGATTTT TTTTTTTGTTTTAATCCATTTGGGTTCAC GTCAGATCATCGGTA | | | |
| 1323 | 3147137 | 5 | GRHL2 | TTTAGGAAAAGGCTGCTATACTGTGGAC GAAGTCTCAGATCAGAA | 5.83E-05 | 0.007715533 | 3.80E-06 |
| 1821 | 3147154 | 5 | GRHL2 | AGACAGATTATGTTGGATTGAGAAATGG GTGACAGTTTAAGATGTCGGGCAGGAAG TGTAGGCTCCTCTTTTAAGAAACATGAG GTGCCTG | 0.000250234 | 0.006855299 | 2.16E-06 |
| 1778 | 3147288 | 2 | RRM2B | TTTTTTGGCTTAGTATGTTGAAATAAACT ATGG | 0.000691504 | 0.00650489 | 5.26E-06 |
| 1312 | 3147309 | 4 | RRM2B | GAAAGAGGACTGTGGCGGCTCTGCTGGA GAGGTGCATACCATTTGGGATGGTGACA AGGAGTTGGAGAACGCGTGTGGAAATTG AC | 0.002509145 | 0.006651229 | 1.26E-06 |
| 133 | 3147316 | 8 | KB-431C1.4 | TCGGTTGTTTACGCACGAAACCAGCCAG CCC | 1.68E-05 | 0.02024896 | 1.20E-05 |
| 95 | 3147353 | 9 | UBR5 | CAGAGATTAAGGAACCGAGGAGAGAGA GACCCGGAAAGGGAGAGAGAAAGGGAA ATGAGGAGGAGTAGTGGTTTGCGAGCAG GTTCTCGAGGGACCGGGATAG | 1.40E-05 | 0.029777153 | 2.71E-05 |
| 1951 | 3147355 | 9 | UBR5 | CGGGATCGAGATCTTCTCATTCAGCAGA CTATGAGGCAGCTTAACAATCACTTTGG TCGAAGATGTGCTACTACACCAATGGCT GTACACGAGTAAAAGTCACATTTAAGG ATGAGCCAGGAGAGGGCAGTGGTGTAG CACGAAGTTTTA | 4.38E-05 | 0.008446581 | 2.80E-06 |
| 57 | 3147362 | 9 | UBR5 | ATGATAAGGATGATGACTCTCTTCCTGC AGAAACTGGCCAAAACCATCCATTTTTC CGACGTTCAGACTCCATGACATTCCTTG GGTGTATACCCCCAAATCCATTTGA | 3.58E-05 | 0.042037758 | 5.21E-05 |
| 693 | 3147378 | 4 | UBR5 | GCCAGTATATGTGTCCCAATTTTTCCTTT AATGTCAGGTGTCCCTTTAATCTAAATCC AGTTTTGTCTGACAGAGCTCTCCCATAGT ATCCTTGATACTGATATACATCCAGGAC TTGTTGAAAACTGTTACAAATCAAGCTG TGTATCTTCAGACTTGTCAAATCTATCCC ATGATTAAATAATTCTGCTTGTGAGATCT GCTTGGACTCTGTATGATTTTCCTGATCT TGATACCCTGTGAGGAAC | 1.55E-05 | 0.014008764 | 7.94E-06 |
| 1937 | 3147416 | 4 | UBR5 | CTACACAGTAGCACAGGAGGCATTGGGA AATCACAGGAGGCTGCACAGAATGATTA CAAAGAGTGTGGACTCTGAAGTCAAACT GCTGGATTTCCTATCCTAATCCTACCACT GTCTAGTTGTGTGATCTTGATCAAGTTCT TTAACTTCTCTCTGCCTTGGTTTTTCTCAT ATAGATAGATATAGTAATACTTTTTACAT TATGGGTTTGTTATGAGAATTAAATAAG TTAGTTTATGTAAAGTGCAAAGAGCAAG GAGAAGCATGGTCCTGTCCCAGGAAGGG AGAACGGGCAGTTCCTGCAGGTCATGGG AGGGTGAGAGAGCCCAGTTGGGTATTTC GAAGTACGTTATGTGGCACTTGTGTGTT ATGTGCCAGGTTCTCTGTTAGTAGTGAAT TGGACACAGACCAAAAGATACAGATC ATGCATGCCCCCTTTATCTGACTGGACTA GAATGAATTCAAGTTATGAAAACATTTT | 1.05E-05 | 0.007966735 | 3.42E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 571 | 3147425 | 9 | UBR5 | ATTATAGTAATAATTTAGTGTAATAGGA AATTAAGGGCAGCCTATATGTACCAAAG TGAGAAGGGGAGGGAGTGCCTAAGTCTG TGCTCTAAGTTC GTCAAAGTTGAACAGCAACTCGGGGGCA GGGAGGACGTCAAGGCCTGGTAGGACA AGCGACTCTCCATGGTTTCTCTCAGGTTC TGAGACTCTAGGCAGGC | 0.000504026 | 0.016922667 | 1.60E-05 |
| 90 | 3147426 | 9 | UBR5 | TGGTTTTTCAGTACAGCCAGACAGATTG GAATTGGGTAAACCTGATAATAA | 3.18E-06 | 0.031095942 | 3.24E-05 |
| 175 | 3147427 | 9 | UBR5 | TTGAATGTATTGGAACAGGCTACTATTA AACAGTGTGTGGTGGGACCAAATCATGC TGCCTTTCTTCTT | 5.48E-06 | 0.025869674 | 1.89E-05 |
| 1992 | 3147613 | 9 | AZIN1 | TTGATGATGCAAACTACTCCGTTGGCCT GTTGGATGAAGGAACAAACCTTGGAAAT GTTATTGATAACTA | 0.000264928 | 0.007282996 | 6.61E-06 |
| 1750 | 3147677 | 7 | ATP6V1C1 | TGTGGGTGTTGACAGTGCTCATTGATTG AAATTTGAAACGTTCAGAAATCCCATAC CTGAAGATGGTCACATATTCTTTACATCA TGATTCAGTAACTATTCAACAGTTATGTC TACTAAATACAGTGAACAAAACAGTATA AATGTTTACACCATTCCCTGTGAACAG GGCTTTTGTGCACAATAGTAAC | 0.02057934 | 0.007555028 | 6.58E-06 |
| 793 | 3148720 | 9 | TMEM74 | ATGGAGCTCCACTACCTTGCTAAGAAGA GCAACCAGGCAGACCTCTGTGATGCCAG GGACTGGAGTTCAAGAGGGCTGCCTGGT GACCAGGCAGATACAGCAGCCACAAGA GCTGCTCTCTGCTGTCAGAAACAGTGTG CATCCACCCCAAGAGCAACCGAGATGGA AGGGTCTAAACTTAGTTCTTCTCCAGCAT CCCCCTCCTCCTCTCTGCAAAACAGTACT CTTCAGCCAGATGCCTTTCCACCAGGAC TTCTC | 0.007582294 | 0.010273983 | 6.22E-06 |
| 1693 | 3148899 | 4 | SYBU | GCAACAGCCACCAAGAAGGGTTCTCATC ACCCTGTTATTCAGGGCCAGAGTTTCTTC AGGAGTTCAGGAAGAACGCAACGTATTT AAAAGAGCCCGAAGACTGCAGGCATGA GCAGCACCCTAAAAACCA | 4.91E-05 | 0.006815011 | 2.32E-06 |
| 1953 | 3149782 | 3 | EIF3H | AGCAGTCTGGCAGGCCTTCTCAAGTAAA TACCAACCCTGTTTCTGCAGCAGCCTCA GCAGCAGCTCAGTCTAGACAGGGTTTCC TTCTTTCTGTTTATTTTTCTTGCTATCAGA GCCCTGATGTGTACATTTTGGAATGCTG GAGTAGCTGCTTCATTTCTATTCCTCCAT CTCCCCTCCCTCATTGAAGGGGCTGGTG GAACTAGACCAGATGTCTAACAAACCCC GATTGCTAGAGTGTCTGGCTCTGTACGT GACTGACCAATCATAATACGGTGTGCCA AGTTTTTTTTATACCTCTGACAACAGCGT ACAAAACCTGGACTGTTTC | 4.99E-05 | 0.006519112 | 2.50E-06 |
| 1978 | 3149863 | 9 | RAD21 | GATTCAGTGGATCCCGTTGAACCAATGC CAACCATGACTGATCAA | 3.09E-05 | 0.010598225 | 6.84E-06 |
| 2069 | 3149864 | 9 | RAD21 | GCAGCCTGCACATGACGATATGGATGAG GAT | 0.000142286 | 0.006938925 | 5.44E-06 |
| 96 | 3149866 | 9 | RAD21 | AGCAGTTCAGCTTGAATCAGAGTAGAGT GG | 5.86E-05 | 0.032413212 | 3.97E-05 |
| 566 | 3150181 | 4 | EXT1 | TGGATTCCAAATAATGGGGCTTCTCATA AAAGATTTGGACCCTGCCCCGAGGCTTT TGGTAATAAATGTGGCCGCTTTGTTTTTT TCCCTAATTATTTCATTCGTAAAGTCTT ATCTTCCCAATAAAGATGGTAACTCCTCT GGACTGGGTCTGCTTTTCGCATTTTCCTT C | 0.007337714 | 0.011167989 | 7.79E-06 |
| 200 | 3150260 | 1 | | AGCAGTTCAGCATGGGACTAGTACCAAG ACTCACACTAAGGAAGAAGGAGTTGGA ATAAATTGAAAGAACACTCTGGGGTTGT GCATTCCCATTGCAGAATTGGGGACAC TGCTGTAAATGGGGAGTACTCACTGGA | 0.005450518 | 0.009774559 | 1.03E-05 |
| 1535 | 3150537 | 4 | RP11-4K16.2 | TTGTCATTCAACTCACAAGTCTAGAATGT GATTAAGCTACAAATCTAAGTATTCACA | 1.59E-05 | 0.012061709 | 7.83E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1956 | 3150666 | 9 | TAF2 | GATGTGTCTTAGGCTTGGTTTGTAACAAT CTAGAAGCAATCTGTTTACAAAAGTGCC ACCAAAGCATTTTAAAGAAACCAATTTA ATGCCACCAAACATAAGCCTGCTATA ACCTTTGGAGATGAGTATGCATCCAGCG GCAAGCGCTCCACTCTCAGTCTTTACTAA GGAATCTACAGCCTCCAAACACA | 2.80E-05 | 0.007484629 | 3.54E-06 |
| 221 | 3151057 | 1 |  | TGGGAAGTTTAGACCAGGAAATTGCAGC TGTATTCACATGCTATCATGCTTCGGGTA CAGAGAGGCCCTCTATGCCCCATGAGTT CAGAAACCTA | 1.19E-06 | 0.016560632 | 1.54E-05 |
| 1758 | 3151568 | 4 | ATAD2 | CGTTTTTTAACCAGGGATGATGCCATCCC CCTCCCCGAAGGGACAGATATCTAGAGA CAGTTATGGTTGTCACAACTGGTGGGGG CAGCTACTTAGCATTTGGTAGATGAAGG CTGTTAAACATCTTACACGTACAGGACA GCTCTCCACAACAAATAATTATCTGGCC CAAAATGTCAGTAGTGCTAATTTGGGAA ACCTTTATCTAAACAATAATTATCAATG GCCACTCAAGCAGTAAGATAAAAAAGA AGTTTGATGGGGATATTTATGATGGGTG GAACAAGCTGTTAACACCTGACCGAAAC TCAACCCACTGATTGACCTTAAATGGGA AACTGATATTAGGTGCCTCCTGTGGGGA TATAATAG | 0.000958852 | 0.006912877 | 2.11E-06 |
| 1148 | 3151571 | 9 | ATAD2 | ATCAGATGCGCCCATCAATTATTTTTT GACGAAATTGATGGTCTGGCTCCAGTAC GGTCAAGCAGGCAAGATCAGATTCACA | 2.14E-06 | 0.01249276 | 1.03E-05 |
| 1530 | 3151576 | 9 | ATAD2 | CATGCAATCCACAGTAGTGACTCGACTT CATCTTCCTCCTCTGAAGATGAACAGCA CTTTGAGAGGCGGAGGAAAAGGAGTCGT AATAGGGCTATCAATA | 0.021434136 | 0.007350183 | 7.31E-06 |
| 1931 | 3151874 | 1 |  | CACATATTGGAGTTCACTGGCAAGAACT CTAAGATAACTATGACTAATGTGTTTGA GACAATTATGGATAAGATAATAGGCAAA GACTTTGATCAGAAAAGTAATCTATAAA AATCAAATGGATATTCTAGAACTGAATA CAGTGTCTGGAGTTGAGAACACAGTAGG TGGATGTAATAGTGGATTTGTGTAACAA AAGACAAGATTAGTGAACTACAAGACA GGTCAGTAGAAAAAAATACATACTGAAG CATGTATTGGAGGCATGTAAACACAATG AAAAGCCTTTAGAAAGATAATTGGAGTC TTGGAATAGAATGGGGCCAAAGTA | 0.00010865 | 0.008065512 | 2.97E-06 |
| 1544 | 3151880 | 1 |  | CTTTCTGCCTTAAACCCTGGTGCTCACTT CTCTTCTTTACTAATAAATGTTCTTTGTG GCATATTATTATTTTCCATAATAGGGCA CTTCTGTCTGCCTTAAGAACCTGTTTTGG TAGATATGCTTTCTCCTCAATGATTTTCT TAATGGCATCTGGGAACTCATTTGCTGC CTCTTGGTCATCAGGAGCTGCCTCTTCTG TTATCTTAACATTTTTAAAGCCAAACTTC TTTCTAATATTATCAAGCCATCCTTTGCT GGCATTAAATTCTCTAGATTTAGATCCTT CACCTTCCTTTTGCTTTAAATTGTCATAT AATGACCGCCTTTTCTCCAATCATATTAG AGCCTATAGGTACGTCTTTCTTGTAGCAA TACTGCACCCACATAAAAGTTGCATTTTT AATACGAGATAAAAAGGTATATCACAAA AAGTGTAAGGTTTGCTGGTATAGATGCA GTAATGGCTTCATAAATTTTCTTAATTTT TTTTAACAGTGGTCCTTATGCTGGATTCA TTTATCTTGAAGGATGGCAACTACAGC TGCAGACCAGTACACATCAAGCAATTTA ACTTTTTCTTGTAATGTCATGACTTTGCT CCTTGGGAGCACTTCCAGCGTCACTAGC GGGACTTCATATGGGTCCCTTGGTATTAT TGCAAGGTTTATGGTTGTACTAAACATG ATGAAAAATAACTGAGAACCATGAGAG ATCACTTTTTACTACGATACACAATTTAC | 0.000986793 | 0.007880354 | 4.89E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1541 | 3151942 | 5 | RNF139 | TGGAGAGATGAACTGCCCATGTGGAGAT GATAAACATCACATGGCATTTTAAGTGA ATACAGCACTTGAGCTCACAGCAACAGC AACAGGAGGTAGCTCTGAAATTATGGTA GTAGTGCAGTATGTACTATAGTTAATCTT ATCCAGTTGTAATTTAGTACTGCATCTTT ATGTTTGTCTCAACTGCAAATGGCTCCA ATGTATAGTCTGTGTA TGCGCCTGTGTGCTGAATCACTCCATTTC TTTTCTCTTTGAACATCATCATCACAATCT GTACTGTCATCTTCGTTCAATTCCCTGTC AGATTCAGCAGCAGCTTCTCTTACAGCTT CCTCTGGAGTTTCATTGGGTGGAATAAA TCCATTGTTGTTAGATACATTTGAATTAT CCTTGATATCATCTTCGATGTATACTTTC TGATGGCACATTGGACAAGTATCTTGAA TGTACAGCCATTTCCGAAGGCAAAGTGC ATGGAAATAATGATTACACGGTGTAATA CGAGCAGATGTTGTAAACTCATGATAGC AGATTGCACATACATCATTTATTTCTTGT AAGCGGCTCCCTTTTATTTCAGGAAGTG AATTAATTTTCTTCACAGCAGTCCTACGA TTCATAAATGTCTTCCAGCCATTTTTGGC TTGTAAGTAGATGTTAAAATATGCATGT AGGCACATCATAAAAGCCCGAATTTTAC TTCCCGACTCAAACATCATAGTGTAAGC CCCATTTCCAAACATTACAACTCCAAAT ATAAATTCAATAATACTGCCTGTTGAAC GAACGTAGTAGACATAATCGTCAAGCTT TTCCCAGAGGACATTATAGTAGCC | 0.000302186 | 0.01206077 | 9.57E-06 |
| 725 | 3151996 | 9 | MTSS1 | AATCTCAATGCTAGGGGAAATAACCCAC CTTCAGACCATCTCGGAAGATCTAAAAA GCCTGACCATGGACCCTCACAAACTGCC CTC | 2.75E-05 | 0.013085414 | 6.46E-06 |
| 2011 | 3152016 | 9 | MTSS1 | CGCTTTAATTGATTGTCTGATAAACCCAC TTCAAGAACAGATGGAAGAATGGAAGA AAGTGGCCAACCAGCTGGATAAAGACCA CGCAAAA | 0.001921299 | 0.006534607 | 2.49E-06 |
| 1564 | 3152038 | 4 | MTSS1 | AAGGTTTCTGGCTCTAATCAGCCCATCA CAAAAATGAGATGAGTATTTCCCTGTTG TCATAACCCCTTAGGGTGAGGAGTGTAT CCTTGGTGACAGACCAAAATCAAATCAT TTTTACAAATATTTATGGAGTATGGTTTG AGAGGATGAAGAAGAAAAGCATGTGGA AACATGGGCAAATTGGGACTTTTTAT | 0.002514771 | 0.006782061 | 3.70E-06 |
| 1573 | 3152088 | 9 | MTSS1 | TGATTGAGAAGGAATGCAGCGCGCTCGG AGGCCTC | 0.038614454 | 0.007217448 | 6.83E-06 |
| 1877 | 3152261 | 9 | KIAA0196 | GAGATGGTTCTGGACAATATCCCAAAGC TTCTGAACTGCCTGAGAGACTGCAATGT TGCCATCCGATGGCTGATGCTTCATA | 0.000153344 | 0.008032919 | 2.64E-06 |
| 1042 | 3152298 | 5 | NSMCE2 | ACTGGTGGAATGGTGATGTCTCTGACAG AAACCAACCTAGATCTGTGATTACAATA TATTTGGGAGTTATGACAATCTTATCACG AGTTTCATCTCCTCCATCTCTGTTTTCCCT GCCCCAACTCATAAACTTCCTTGTATTAA TACAAAGATGTCTTGGA | 0.031432454 | 0.00702341 | 4.58E-06 |
| 496 | 3152302 | 5 | NSMCE2 | ATGGCACAAAACGATGCAGATGGGCATC ACCT | 0.000199853 | 0.012091556 | 8.22E-06 |
| 1029 | 3152910 | 8 | PVT1 | TGGGGCTAATTATAGCACCATCCTCCTA GGATTATTACAGGAATTAAATTATTTAA CAGATGAGACCAAATTCGCACTGCCCAG AAGTTAATAAGCACTAGATAAATGTCAG CTATGATTATTAGTTACTAATCTAATTAT TATCATTAGGAAGTCATTTAATTTAACTG ATTTGACTGGTAGGTTCTTCATGAGTTAT CAATCACACAGAGATTTACCAAGGAAAG GCCATAAAGAAAAGAAGGAAGAAATT AGCATTCTTTGTCAGCTTCCTACACATGT GATCATTTCAGGTCAGGATTTCACATTC | 0.025177619 | 0.00679582 | 3.81E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 874 | 3152978 | 8 | PVT1 | TTCAGCTGGTCCAGACGCAGTGGCTCTG ACGTTCTCTGGCAG | 0.018228464 | 0.007100921 | 6.91E-06 |
| 157 | 3153331 | 2 | FAM49B | ACGGGCCATCTAAGGCAGCTAATTATGC ATTGCATTGGGGTCTCTACTGAGAAAAA TTCTGTGACTTGAACTAAATATTTTAAA TGTGGATTTTTTTTGAAACTAATATTTAA TATTGCTTCTCCTGCATGGCAAAACTGCC TATTCTGCTATTTAAAAACCCTCAATGAC TTTATTTTCTACTGCCGCCTTTTTCATGTG CAACCAAA | 8.86E-07 | 0.031562714 | 3.42E-05 |
| 481 | 3153338 | 4 | FAM49B | GGCTTCTACTACGTATTTGGCAATATAA ATAGATAATTAGATATAAGGAATTTTGA GTCATATCCTTTAATTCCTTTGGCCAAAG GCCATTTCAAATAAAATGTTTATTTCAGA ATGCATATAAAAAGTCAGTAGTGCTGCT GGGCGTGCTGGCTCATGCCTGTAGCCCA AGCACTTTGGCAGGCTGAAGCAGGAGGA TCACTTGAGCCCAGGAGTAGAAGACCAG CCTGGGCAGCATAGTGAGACCCCCATTT CTACAAAAAAAAAAAAAAATTAGCCA GGTGTGGTGGCACACATCGGTAGTCACA GCTACGTTGAGAGGCTGAAGTGGGAGGA TCCCTTGAGCCCAGGAGTTCCAGCCTGC AGTGAGCCACGATCACACCACTGCATTC AGTCTGGGTGAGAGAGAGACCCTGTCTT GAAATTAAAAAGACAGCCAGTAGGATG CTCCAGTGGAAAAAGATGAAGACTTTAT GTATTTTCCCTCCCCTACCTAGTCATAAT AATTTGTGACTATAGTTGGCTCTCGACTT TTCTTCTCTCTGTAAAAGTTTGTATTAGA AATAGTTTTCTAATTTCTCTACTTCGTAG TTTCTTTCCCCAACCTCTCACATCTAGTT CATTAGTGTTTGGTGAGAATTGTCTTCCC GTTTCCCTTTCATAGCTAGTTTAGGCTCT TAGCATTTCGGATCTCGATTACTGATTAC TAGCCAAGCTTGTTGCCTTCATGTACACC TGTCA | 0.000449203 | 0.008890397 | 4.61E-06 |
| 1474 | 3153369 | 2 | FAM49B | CTGGAACAAGTGAACTAGGAAAGAGGG AACGCCAATCCAAG | 0.016492423 | 0.010486458 | 6.26E-06 |
| 542 | 3153531 | 9 | ASAP1 | GAGAAAAGAGAGCACGCAAAACAACAT GGG | 0.000611594 | 0.015079374 | 1.42E-05 |
| 791 | 3153572 | 4 | ASAP1 | TTATTGTGATGGGAGATAGTCGTCCTGC ACTTCTGTAGATTACAGGCCAGCAGGTG GAAGCCTGGGCTGTGGAATCAGATTGGG TTTGAGTCCAGGTCTGCTTCTTGGCCAC TGGGCATGCAAGGCCTTCATTTTC | 0.000563692 | 0.013482063 | 1.03E-05 |
| 1713 | 3153586 | 4 | ASAP1 | GTGAGTCGTAGACCCTGTTCCTACAGTTT CAACAAACCCTGATGGTGGCATTTCAGT TTATCGTAGAGGTTTCTTTTCCCCTACAA GGGTCATTCTCTCTTGCCCAATTTTGGCT GAGAAGGGAGGAATATCATGGCCGTTTT GGCTGTATGGTGTTACTGTATAATGATAT GGGGATTGGTGAGTGAAAAATAAAATG AACCCTCACTTGCTTAGGTACCAGTTT | 0.003557945 | 0.007447963 | 1.39E-06 |
| 517 | 3155043 | 5 | KHDRBS3 | GCACACGGCGACCAACTCAAACATAAAA TTTAAGTTCAGAATCTGGATTCATGCAAT CTTCAGCAAGTCTTTAGTCCTCTTCAAAT ATTTATATAATAAAGGAGCCCTAAAAAT AGCTAGACATGCACAAATGAATTGACAG GAAGCTGCTGTTTCAGAGTCCAAATGTC CTTATTCTCTTCCCATTAATATCTTTAAG GTCTTTCTACGGCCATCTCTCCTCCCTCT CTTCACATGCTCTGGCCAGTCACTCACCG TAGGAATCATAAGTCTCCTCACTGAGTC CATGTCCGTAATC | 0.000319739 | 0.010247178 | 7.03E-06 |
| 1984 | 3155047 | 5 | KHDRBS3 | GGCTATTTCACAACATCAGACAGTACAA TCAGTATCTGCCATATGGCTGGTCTCTGT AGACGCCCTTTGCGTGTCCTCGCTGAAGG TGCCTTGTGTCTTGAGTTAGTCCACTC | 0.000192114 | 0.006667798 | 4.43E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1262 | 3155524 | 4 | FAM135B | TGCAGTCACTGCAACAATGACAATACCA ACATACCTGGCCTAGGGAATGCTGGCTC CCT | 0.00247563 | 0.006678738 | 3.02E-06 |
| 490 | 3156104 | 4 | TRAPPC9 | CTTGGGGCTCGGATTCTTGAATCTTTATC AGTGGGAGTCAGAAATTGCCTTTGAGTT CATTGGCATG | 0.000636171 | 0.01047113 | 6.63E-06 |
| 1914 | 3156387 | 9 | PTK2 | TTGGCCAACAGCGAAAAGCAAGGCATGC GGACACACGCCGTCTCTGTGTCAG | 0.036159066 | 0.008448362 | 6.92E-06 |
| 958 | 3156443 | 4 | PTK2 | TTTAAGAAGCTGCTCCGTGTTTGGCCAA ATTGGAGAGA | 0.000130223 | 0.010054359 | 6.30E-06 |
| 388 | 3158057 | 5 | SPATC1 | CAGGCCTTTCCTATGCAGCACTCGGGAC ACTGCCACGGACGGGCTCCACGGCAAGT GAGTGGCAGCAGGTGTCACAGAATCTCT GTCTGAACACAGGGTGGGCGCATTACAA ATCAATC | 5.48E-05 | 0.018175287 | 1.55E-05 |
| 745 | 3158586 | 9 | SLC39A4 | CTCCCGGCGATGTTGAAAGTACGGGACC CGCCGCCCTGGCTCCTCTTCCTGCTGCAC AACGTGGGCCTGCTGGGCGGCTGGACCG TCCTGCTGCT | 0.000385118 | 0.010205084 | 4.89E-06 |
| 1461 | 3158698 | 2 | CYHR1 | CTCTGTCATGGGGTCTTGAGACTGAGGC TTGGGCAGGAAGATCCAGGTAGGGTCGG GGCTGCCCTGGCCAACCGGCCGCTCCCA GGGAGACAGGACTCAGCCACCAGGGCTC AGCAGGCATTTTCCGAAAGCAGGGTGAA ATTGTCTCTTCCCAGGAAAAAGATTAAA CTCCTTGCAGGCTCTTGGATA | 0.004759574 | 0.010659625 | 7.27E-06 |
| 239 | 3158768 | 2 | AC084125.3; RECQL4 | GTAGAGCTGGGGTTGTCAGAGGCTAGGG CAGTGACTGAGGACCTGGGCAAAACCTG CCACAGGGTGTGGGAACGAGGAGGCTCC AAAATGCA | 0.000189098 | 0.02025759 | 2.25E-05 |
| 332 | 3160259 | 8 | KIAA0020 | ATGCCTGGCCGCTTTCCTTACTTCTTATA CAAACATTAACTCAAAATGGACTAAAGA ATTAAATGTAAAATCTGAAACCATAAAA ACTCTAGAAGTAAATCGGGGCAACACCA TTTAGGACAT | 0.009010521 | 0.018759046 | 1.78E-05 |
| 205 | 3162826 | 5 | NFIB | AAACAGCCTTCTTCACGCTTCGGCTCCCC TATCGATTCAAACGTAAA | 0.000288505 | 0.016847222 | 1.49E-05 |
| 1420 | 3163197 | 7 | PSIP1 | CGTCTCAACGGCTCGGAATCGCAACCGC GCCGCCGCTGCCGCCGCCGTAGCTGCGC TGCTCCCGCGCGGCTCCCGCTCGGCGCC CGCTAGCACTGGGGCGCGACCAACTGTT TACCGAGAGAGGGGGGATGTTGCAGCAC CCGGCGAAGCTGTGTGGCTCCGAAGCGG ATTTTCTGGAAACCCTACGTCCCCAAGTT CGCTTTCATGTAACAGGTGCATGCAGAT GGAGAGGAAGACGCAAGCGAAGAAGAA AGGACTGGGCGAAAATAGCTCGGCCTGC CGCA | 7.08E-06 | 0.009902923 | 2.89E-06 |
| 2041 | 3164984 | 4 | MTAP; CDKN2B-AS1 | TTCTCAGGAGTTAGTGGTAAACCCATGA ACATGTATTTTTAAACCAAATTACCCACC TCTTGGAGTTCAATCTCTGTTAATTCTTT ATTAAAGTAGTGAAGTATCAGTGTTCC AATGATATAATGATCAAGCAACCCTGGA AATTAAATCCCAAAGCAGTGCACCTTTA GTTTGTTCAGTGATAGTAGGACATCCCA CGAGCCATCATATATTTTCAAGTTTTTAT ACTCAATCTACTTTTTCAGCAATCTTTTG GGAACTATCCCAAGATAATTTACTGCAT AAGTGCATCTATCTTCTAAAAGACATTT GGAATATTTCTTAGTCTGACCTCTGCACC CTGAGACACTCTATAAAGGAAACAATCA GAAAAATTTAACAAAGAAATAAATAGGT TAAGAAGAAAGCAATCTAGGCGTTTGCA CTGAGTTTGCA | 0.01575619 | 0.006644381 | 4.63E-06 |
| 644 | 3165859 | 9 | TEK | GGCAACCAATATTTCCAAGCTCGGAAGA TGACTTTTATGTTGAAGTGGAGAGAAGG TCTGTGCAAAAAAGTGATCAGCAGAATA TTAAAGTTCCAGGCAACTTGACTTCGGT GCTACTTAACAACTTACATCCCAGGGAG CAGTACGTGGTCCGAGCTAGAGTCAACA | 0.001040005 | 0.011526316 | 8.47E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1214 | 3168684 | 4 | RP11-220I1.1 | TAGCTCACTGTCAACTTTGAACACTTGGG | 0.008902214 | 0.008733067 | 7.44E-06 |
| 876 | 3173552 | 6 | | CTCGAGTGGGTCCTGTTGGATTGAAGTCTGACAGTGGTGATTCCCTTCAACAAA | 0.001890803 | 0.008001967 | 7.79E-06 |
| 886 | 3173564 | 4 | PGM5 | GCTGACTTTACTATCAAAAGCACTTGAAATTTAAAAATTATGTCCATGATTAAAAACTTGCAGAAGTTGCCCAGCAACTATTTTCATTCCCCAGAGGCAGAGAGTATAATGGAAAGGAGGAATTTGGGGTGAGATGTCTTTCTTGTGTTTAAATTTTCTACTCTGAACTTGGACAAGTCACTTATCTTCCTAAATCCCAATTCCTCAT | 0.001187787 | 0.007799223 | 4.99E-06 |
| 1281 | 3173991 | 4 | FAM189A2 | TCTCGACAGTATTCTGATGCTTGCAAAAAGAAATACTATCATACCACGTTGTTCTGTGACAGAAAGCTTCTAAGATAAGTTTTTGGAATTAAGAAGTACACATTATTGCATGAGGGTCATAATAATAGCCAGCATTTATTTGGGCACTTTCCACGAGCCAAACACCATCTAAGTCCTTTACATGCATCTCTCCTGAGAATTGTCTTATGGAGGCAGCGTTATTA | 0.022116149 | 0.007416716 | 3.04E-06 |
| 1349 | 3174918 | 3 | RP11-549A6.1 | AACGGCGTGCTGACCTACCATCCAAATTTACATGATTACATGAAGAATATTCATGGTAAAGAGATTGACCTTGGGAGA | 0.007322669 | 0.00657993 | 4.06E-06 |
| 524 | 3175377 | 9 | PCSK5 | GCAGTGCCACTCCTGCCGACCGGGCTGGTTCCAGCTAGGAAAAGAGTGCCTGC | 0.015107347 | 0.00744564 | 4.09E-06 |
| 1864 | 3179420 | 4 | CENPP | GCATTTATATAGAGCTTTCGGTTTCTGTCTGTTTAATTTGATGCTCTGCTTATTCAGTTATACTAGATGTGTTTCTCAGAGTTATCCAGTCCATACGTATTTGAAGAGACAATTTGGTGTAGAATTGTTAGTGTCCAGGCTCTTCCAAGCAAGGTCTTCCAAAGGGATATCTCAAAAATATTCCTTAGAGTTGAAGTGGCAATGTTATATAGCCTAACAATTTTCATGCTATTAAAAGCTTATAATAGCGGATCATTAAAAATGCGAGTTACA | 8.56E-06 | 0.008122664 | 4.87E-06 |
| 1878 | 3180308 | 6 | | GATCAGTTTCGAATCTGCCTCCTCGACCAACTAAAACTGGGGAGTTTATGTACCGAAAAAAGGAATGTAACTATGTGTGAGGAAAACAGCAATTAGGAAAAGGATAAGGAAGCAGTCCTGACCTATGAGGGGAAAGAGGTGTCTGGGGTCTCATTGTCAAATGGTGATTTGGTGAGTTTCAGTCCGTTGCCTGAGGAAAGA | 7.16E-05 | 0.006665582 | 1.89E-06 |
| 878 | 3180982 | 2 | HABP4 | GGGGAGACTTTTCCAGCTGGGCCAAGGGAGTCAGACTCTAAGAACAATAGATGTTGCTTTTCCCGTGTCATGTAAATTTGTTGCACTTTTTTGGGCTGAGCTGTTAGAGGGGCTTCTCCAGAGGCTCGAGAGCAGGCCATTTCCCAAGAAGATGAAGAATGGTGACTGTGTTTTTATTGAAGGAATTTCAAATGAAGAATAATGTTTAAAATGTGTATATAGAGATAGTATAGACTCCTCCGCGGAAGCATGGAGGGAAAGGAGGTTGTAAAATAGACTCCATGGAGACTCTTAGGAAGCAGTAGATTCCCGGGGGCTGTGCCTTTAGCGTTAGAGGAAACACATAGAGCTGGAACTGTTAATGGAAAGCAGTCACAGCTGAGTTTTCGGAGACCAA | 0.000525832 | 0.014120969 | 1.08E-05 |
| 1598 | 3183013 | 4 | NIPSNAP3B | TGGCTTCAAATGCTATCTGTGTGTGGATAGCTCCTCCAGTCCACACCTCTTTTCTGAATCTTTTTTCAAATTCACACATGTGAATTTGAATTCCAGGCTCATCACATCCAGGTGTGTTCCCCACACCTCCACCTGAATGTCTATTAGAAATCTCACACCCCTCTTGTCCAAAACTGAGCTCTTGATCTTTAACCAGAAACTTTATCTCAGCTATTGGCAACTCCAGGTTTCTGTTTTGCTCAGGCCACAGACTTCAGAGTCATTCTCACACTGCCTTTTCTCTCATACACCATTATGTACCTGTCAGCAGGTCCCAAATATCTAGAATTTGATTGCTTCACATC | 0.027405312 | 0.006936068 | 3.26E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 953 | 3184500 | 2 | PALM2; PALM2-AKAP2; AKAP2 | CCTATAGCAACTCTCCTGGTTCAAGCCC ATCATCATCTGGATTTTTGGGAAGTGGTC TTAACTGGTGTGCTGCCCTTC AACACAGTTTCCTTGAGCCTTCTGAGCA ATCTTAGAATTATTCAGAAGCTTTCAGG AAACTCAAATTCTATTAATTTGATTTGGT TCCTTTCCAAAATGTTAATAGACATGTAT TTGCTTAAAACGTCTACCTATTCCATTTA ATTTCCTGCTGATAAATGTATTTTATCTA CAAGCAAGTAGAATATTTTGTTTTGGTTA AAGTCAAGTTTTTATAAAAGGAGGGGAA GTATAAGAGAGAGTTTCCTAGAGATACA ATATCATCTCTGGAGCAAAATGTTGAGG CCAAGTGTAAAAACAGACTATTTCTCTTT ACTTCCTGCAGAATTTCATTTCAAGGGA CCACAGCACACCCTTGAAAATTACCATT TATTTAATGCCAGTTGAACCAATGGGTA GCAAAAGAGGAGGGAGGGAACATGGTC ATAGAGACAAAATCTAACTACTATACCA GGTCTTCCTTTGTAAGAAATATTAGCCCT GCCAATATAAAACGCAGATGGACATAGA CAGAATAAGCATCGAGGACTTTTCTTA TTTACTTGAAATCTAGAAGCTCAGTCATC TCTGCTCATCCCTGGACCCACTGGAGAG TTTTACTCACTAACAGGTCCTTTCCTGGA AGAAATAACCTCATCTCCTGCCATATTA GTTTACAATAAAAATCATTCCAAAGTGA GCCATTTCACATTGCATTTTTGCCACATG CACATTTGCTATTGAAACCACAGATTCTC AGCATAAGTAAGACATAGGTGTTTCAGA AACTTCATAAATACACGATCTTTCAGGT GCTCCTCAATTTCTTAATCAAGGTATATT GAACTCCAGTGATTAGGATAGAACCTGA AAACATCCTTTGTTCTATTGGATAGTACA ACACAGCAAGAGCACACAGTTATTTGTA TAATAAAACAACTTAATTAATGAGGAAG ATGGGATGTTTGATTCCTGCTACCACCA GTTCACTTCACAAAGGCCTTCTTCTGGTA TTACCAGGAAAACTTTCCTGCATTTTCTA GGGAAAAAGAAAAGTCGTTTATTAGGAG CACAATGCAGATATGTATCTGTGTTTTCA TAGCTTCAGCAAACTTCTTAGTAAAATTC CCATTTCAACAAAAACCAAAATACTGAT TGTTTGAATGTAGAAAGGTATAGAATAA AGACTACAAAGGGGAATTTTACCAGGGC TCCTTAGACCAGCTTCCCCAGCATAATTT TTATATAACTCAAGTAAGCCTCTGCTTCC CCTCTCCTTTCCAGTATAATATAAGAAG GTCGGAACTGTCGCACAAAAGAACTTGA TTTCAATATGAAAATATAATATGTAATTT TGGGGACTGCAGACTTTCTGCATCAAAG ATCTGGACAGCCTTAACTTTTATAAAAA TAATTTTTCAATGTTCTCTTTTACTAACC AGGAAAACAAGATGTTTTCTGAAATTAA TGACTTTTTCTATTTTGGGTCTGTTTTCTA AGTTTTTACAGGTTGAGGTATAAAGGGT CGTCTTCCTCATATTGCCTCTTCATAA TCACCTGGGG | 0.001852254 | 0.008987807 | 5.92E-06 |
| 1871 | 3184589 | 2 | PALM2-AKAP2; AKAP2 | CCTGAGGATTTCTAGCCAGAGGTCCCAG ATGCCTGGGCTGAGAACCCAGCGATAAG GGGGCGTTCCCAAAGCAGACACAGGGAT AAGAACAGAGGAGGCAGCAGCATTGCA CAGCCCCAGGCACAGTGGCAGTTAGGAT GGCTGGAGAGTAGGATAGTTCTATGGGT TGCCCAAAAAATGTGATGCGCTTCATGT TTTCTCTGACTCATGGATCTGGTAGAGAC CATAGACATGATATAGACTAACTTCCCC ATTTTCACAAGAGGAAACCATCCTTAT GACTTACCTTAAAGTTTTTTGTTCTGTTT TGAAGGAAACCATGTGCTTCATGAAACC | 0.000408197 | 0.009970306 | 8.46E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TACAGTTGACAAGAGAATGTACAGCTAA GAGAAAAGCTTAAGAGGCCACACTATTC GCGGAATGGCTTTAGAGGCAGATGAAGT GGTCTTTGACCACAGTTGATTGAACCAG AGCACTTATTGCTTAAAGAATAACAGAG TTCTAGAGCTGGGGGTTCTTGGGCCATG CTCCGTGTGTGGATAAGGAAAGAAATAC TGTTTCTGGGACTCTCCCACAGTCACAA AGCTGTTTTCACTGTGGCCCCTACATCTC TTAACTTTTGCTATTACTCCTATGCTGCC TTCCGGATTACTGCTGTCTATCTTCTTGC TCCACTCACTGAAGATCCTATTATAATCC CATGAAAATGTAAATTACAGTTTACTTG GGAGAGCCAGATTTTCTCTGTGCTCTTGA GTTTTTTATTCATTCAAGAAACCTTGGGC CACCGCTTTGTACATAGCA | | | |
| 413 | 3184813 | 5 | LPAR1 | TAGTCTCCAGTACCCTTCTACCTCCACAA GCTTCGAGATTGGTCCCACCACTTCCTGC CACAAACCGTCAATTTCAGGCACTCCTC | 0.002868156 | 0.010363738 | 7.70E-06 |
| 1922 | 3184980 | 2 | DNAJC25; DNAJC25-GNG10; GNG10 | CTTCACAAGTGTTTTACTTCGACGATGTG CCTTTGATTTAATTTGGGACACTTTTTTA GAAGGATACATTATTCGTGTTTGCAACG GTCTTTGAAGAGCT | 1.35E-05 | 0.009724691 | 6.25E-06 |
| 969 | 3187623 | 9 | CEP110 | TGCCAAATCTCAGGAGCAAGTTTTTGGT TTAGATAAAGAACTGAAGAAACTAAAG AAAGCCGTGGCCACCTCTGATAAGCTAG CCACAGCTGAGCTCACCATTGCCAAAGA CCAG | 0.041709394 | 0.008605407 | 4.58E-06 |
| 1741 | 3187835 | 1 | | TCCCGGCGTCTTCCTATTTTAGACATCTC GCTGCCTCAGTCCCTTCTAATGTTTCCAG CCAGGCTGCGGGGGGAGGAAAAAGAGG TTACTGCTACTTTAAATGTACTGTATGAA GGCGAGGGCTGGAAAGGGGCCTGCTTGC AGGAATACCCAGTCATCTAGTTGGAAAA GCCGCCAGATGGAATACAAAAGGAGGA ACCCAGACGCTCATGGAGACAGCCTCGG TTCATAAATCAGG | 2.54E-05 | 0.007378865 | 4.73E-06 |
| 1429 | 3188396 | 3 | RABGAP1 | GGAGACTCATTACAACTCCTGCTGAAGC TCCTAATCTTCTTCCCTTCTCTTCTACCCT TTCCCCCTACCCTCACTTGGCCTGAAGAC GTTCTCCCCAGAGTTTACCTTGCTCCCCT GGTGCTATGTGTATGGTGAACCTGGCAC TATGGCCGCGTCTGGGACTGGCCAGACA ACTGCTGCTGGCTCTCCTTATTCCAGGAA | 0.000570716 | 0.006841685 | 6.73E-06 |
| 315 | 3188421 | 5 | STRBP | GAAGAAATCTTGAGGGCCCAAGTGAATA ATAAATGGTGCGACGCTCAGAGGCTGGC AATAGGGGCTGTCAATGAAAAAACCACC TACAGTGGAGAAAAGAGCAGAGAAGCA AAACTTCATGTTAATCTCAGGCAATTTG GTGAAGCCAAGA | 0.000850201 | 0.01607902 | 1.45E-05 |
| 712 | 3188741 | 4 | NEK6 | AGCCAGCCTTTGCCACGCTGGGACTCCA GCT | 0.000100405 | 0.010689095 | 8.10E-06 |
| 534 | 3189377 | 9 | PBX3 | TGGCAGGACGCAACAACTCCATCTTCTG TGACTTCTCCTACAGAAGGCCCAGGAAG TGTGCACTCGGATACCTCTAACTA | 0.006232171 | 0.00879012 | 7.47E-06 |
| 989 | 3190108 | 3 | RP11-228B15.4 | CCAGGTGGCAGCTGTCTAACTGGAGCAG GAACTCGGAGACGGATGGGGAC | 0.005040635 | 0.006714995 | 6.12E-06 |
| 405 | 3191266 | 5 | FNBP1 | GTCAGGCATTGTTCCCAGTACAGTTGGT AGACAATCCTCAAACGGCTGCCTCTTGA AAGTGCACACCACGATCAGGGTC | 0.023538302 | 0.014455398 | 1.63E-05 |
| 1151 | 3193448 | 1 | | ACCAGCAAACAAGCCCTAAGGTGGACA AGTGCCACAGCGACTCAAGGGCACCTCC ATCGTGGTCCA | 0.011131791 | 0.009354179 | 9.05E-06 |
| 399 | 3196844 | 2 | RFX3 | TACACTGGAGGCATGCCCATTTGGCAGC AGATGCATCAAATTTGCTTTTGAAAGGT GCTTTTCATTGGACAGAACCATAAGACA CTATTTTGATAACATTTTGAGTATGGAGA GAGAATACAGAGCATTTTTATTATAGTG CTAGAGGGTTTGGAAGGTCATCTATTTTT CTCTGAGGAAAAAATGAGCTGTACATTT | 0.002978182 | 0.009216545 | 4.49E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ATCAGTTCAGAGTAAATGACAGAATTGC AAGAGATTATGCTAATATGTACATAATT TGTGTACATAATTATTAAACCATGTTAAC AATGCAAGCTTCCGTTAAACATTGAATT TTAACTATTATTTGCATACCAATTCCTCT GTTTAAAGACTACTGATTCTGTATTTGGG ACCACTGCACAGATGCATTCTGCTGTTA AGTGGGGGCTGTTATAGTTAGATACTGA AGCAGAAAAAAAGACTTGACTTTTTTT TTTTAAGTGTACATGCTACTTATGCTGAG CTGGACATACAGGAAACCATTCCATTTG GATGACTTTCTTTTATTCCAGGTCTTTTT CCTAATAGTAGTTCAATATGCTGCTATTA TAAACGAGAATTTATAGAATGCAAGGAA TGTAGCAACCTACATAACGTTATTTCCTT CAAAACTATTTCCTGGTTTCTAAAGTATG TGGATTTAAATTGTAAACAGAACCTGAA GGCAGTGTAACTGGCACACCTCACTGTT ACTTATCCCCAATTCTGTAGGATTTGGAT AGGTGGCTGGATGGACCATTGCCATTGA AGAATGTACATCAGGGATCATCGTACCT CGGCTATTA | | | |
| 2047 | 3203380 | 6 | | GTGCAAGCCTTCAAGAAGCAGCATATTA TGATAAACCCCTCCTACAGAAAGGTATC ATTTTTATCACTGATACCACAGGATAAA TTATATATTACGCCATCTTCAAGTAACAG CTGAGGCAACAGAATAAATGCAGAGGC ATTACAATGAATCCCACTTAATATAAAG AACTATACAGACCAACACTTCTCTACAA AATTTTTTTTTCCTCATTGCCAGTTAAAT ACAGAGTTTTACTTTCATAGCTTAACAAT GAAGGGTCATACACTGAAGCCAATACAT ATACCTAGCATTTCAGTCTAAGCTTGTCC ACGTACATA | 6.62E-06 | 0.006812633 | 5.06E-06 |
| 698 | 3203820 | 3 | UBAP2 | TCCATGTAAGAGAACACTGGTACACAAG ACAAACCATCAAATTTGTGATTTTTTTTT TTTGGGAAAACCATATTATATGATAAAT TAAAATTTTGAATAGTTTTTGTTTACTGA CCTGGGACTAAGTATCCTGGGTTTTGCA AAATATGGAGGATCTGTTTACCTTATCG CTAATGGGTACAGCAGAGAGTGGCT | 0.002817689 | 0.016552722 | 1.81E-05 |
| 1386 | 3204770 | 9 | TLN1 | TGTGAAACGGCCATTGCAGCTCTGAACA GTTGTCTACGGGACCTAGACCAGGCTTC CCTCGCTGCAGTCAGCCAGCAGCTTGCT CCCCGTGAGG | 0.035351019 | 0.008277517 | 1.13E-05 |
| 167 | 3204782 | 9 | TLN1 | CCTCCTAGCACTGGGACATTTCAAGAAG CTCAGAGCCGGTTGAATGAAGCTGCTGC TGGGCTGAATCAGGCAGCCACAGAACTG GTGCAGGCCTCTCGGGGAACCCCTCAGG ACCTGGCTCGAGCCTCAGGCCGATTTGG ACAGGACTTCAGCA | 0.023971749 | 0.016308237 | 1.76E-05 |
| 429 | 3205204 | 4 | RNF38 | TCCCTTTTTGCCGAGACGCAGGTGAAAT GATGTCACCCAGGAGAACGCGGAACCCG GTCGAAAGGGTCCTCTCTGGCGTCCTTCT GCTTCCGTGGGTTTCTGGATAGGCTGCGT TTTGTTCTCAGGGGATGCAAGTTCTTCCT TTCAGGGTTGAAGCGTGAGA | 4.84E-05 | 0.013951133 | 8.09E-06 |
| 245 | 3205740 | 2 | SHB | AGGACGCCGAGAAGTTCCCGCGGCAGCC GCGGATCCCGGCCAAGGCGGAGGCTGCG GCTCCGACGGGGCAGGAGCGCGATCCAC GGCGAGGGGCGTACGGCCAAAGGGTCC GCGGCGTGGAGCGCTCGGACCTTCCGCT CTCCCCCGGGCGTGGGCGGGACCCCAT GAGACGCGCCCACGAGGGGCGCGAGAT TCCTAGCTTGGGCGGCGCTAGGCGGAGG GAGGTGTTGCAGCCGCCGGAGCCAGAGA GCTGCCGGCAGGAGGCGGCGGCGGCAA GAACTTGAACTTG | 0.002743526 | 0.0122041 | 1.11E-05 |
| 1054 | 3208576 | 8 | PIP5K1B | AGAAACTCCAGGTATTCGAGGCCTTGCA AAGTGTGATGCTCACCCTCATCTCTCTG | 0.003024609 | 0.006720951 | 4.71E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1241 | 3210613 | 4 | PRUNE2 | ATCTTGGATACAGGTGGCCAGACTAAAT GGTCTCTCAACTTGTCTTCAAGTTTAGGA TTTTAATTTTTGATATTTTTCACTTCTCTC TGGAAATTTGTTCAATTCTCAATTGTTGG GGGAGTG | 0.007218138 | 0.007096218 | 4.96E-06 |
| 259 | 3212839 | 7 | PHBP7 | CAGTGAGTTGGTGATCAGCTCGGCCACC TTGGA | 4.89E-05 | 0.017439809 | 1.18E-05 |
| 2048 | 3214846 | 2 | ASPN | TCATGTCTTAGAGCCCGTCTTTATGTTTA AAACTAATTTCTTAAAATAAAGCCTTCA GTAATGTTCATTACCAACTTGATAAAT GCTACTCATAAGAGCTGGTTTGGGGCTA TAGCATATGCTTTTTTTTTTTAATTATTA CCTGATTTAAAAATCTCTGTAAAAACGT GTAGTGTTTCATAAAATCTGTAACTCGC ATTTTAATGATCCGCTATTATAAGCTTTT AATAGCATGAAAATTGTTAGGCTATATA ACATTGCCACTTCAACTCTAAGGAATAT TTTTGAGATATCCCTTTGGAAGACCTTGC TTGGAAGAGCCTGGACACTAACAATTCT ACACCAAATTGTCTCTTCAAATACGTAT GGACTGGATAACTCTGAGAA | 0.00021566 | 0.007049369 | 3.82E-06 |
| 1938 | 3214862 | 9 | ASPN | TTTGATCTGTTTCCAATGTGTCCATTTGG ATGTCAGTGCTATTCACGAGTTGTACATT GC | 6.07E-06 | 0.006832329 | 4.54E-06 |
| 1023 | 3215437 | 5 | PTPDC1 | GGCTGGACACTGGACTAAGACACTGAAT TCTGTAAGCCCCAGTTTCTCTCTATGAAA CTCATCCCCTGCTTCACAAGCTGTTGGGC TGATTGACTGAGATAAGGTCGGTTAAAG CTTATAGCACAGGGAAAGGGCTTAGTTA ATCCAAGTTCTCTACTTTATTCAGAAACC ACAGAAACAGTTCACAAGAGTCTTCCTT TTCAGCCTTCTGGTGAACAAAACAGAAC TATTTTTTTGCAATAAAGTAGATGGTAG ATGAGAAAGTAGAAATAAGGGAACATTT ATACATTAACCTGGGGTCTA | 0.027851225 | 0.007438226 | 1.37E-06 |
| 1504 | 3219170 | 5 | RAD23B | CTCACCCTAAGAGGCCAGTATTACCCAG ACACCAAATTCAGACAAAAACATCACAA AAAACTACAGACCAATATGACTTATGA ACAGATGCAAAAATCCTCAACAAAATAC AAGCAGGCTAAATCCAGCAACATATAAA AAAGATCATATGCTGTAACCAGTAAAAT TTATCTCAGAAATGCAAGGTTGGTTCAA CATACAAAATCAATCAATGTAATAAAGC ATACTAAAGGACAAAAATCACATGATCA TCTTAATAAAGAAAGAAAAAAAATTTGA CAAAATCCAACACCTTTTCGTGATGAAC AAACTAGTAACAGAAGAGAATTTCTTCA ATCTGATAAAGGGCATCCACAAAAAACC CATAGATAATATCATACTTAGTGATGAA AGACTGAATGCTTTCCCTTAAGATCAAG AACCAGACAAGGATGTTGTTGGTTCTTG CTAGTCTA | 0.001095886 | 0.007364521 | 2.15E-06 |
| 250 | 3220872 | 2 | SUSD1 | AGAGGCTCCGTGTGACTTCCGTCCAGGG AGCATGTGGGCCTGCAACTTTCTCCATTC CCAGCTGGGCCCCATTCCTGGATTTAAG ATGGTGGCTATCCCTGAGGAG | 0.009531934 | 0.011306015 | 8.69E-06 |
| 1917 | 3221558 | 2 | CDC26 | AAGTCGTAGTAGGAAATGGCGTCGTGGC ATTGAGGGGCATCCCTCCTAGAACCTCC AGGAAAAGCTCGCGGAAGACGAGGTTCT GCGGAGAGAGAGGCTCCAAGCAGTCTG GGAAGTGTAGTCCAGTTGGCTTAGCAGT AGTTTC | 0.00011347 | 0.006784429 | 2.24E-06 |
| 1172 | 3222049 | 5 | ATP6V1G1 | GGAGACACAGGTATTTTGGTTTCTAGAA GTGAGTGGCTTAACATACAGCTGGAAAA AATCTCTAGGTTTGGTCAGAGTCTACAT GAAAACAGACCACAAGGACAGCCAACA TATA | 0.00160961 | 0.011736719 | 9.61E-06 |
| 1561 | 3223277 | 1 | | ACACCACCTGTCATGCTGCGTCCTCCTCC TACTCGGGTATCTGACAGTTTCCACGAC ACGTGA | 0.0264846 | 0.006904205 | 5.16E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 656 | 3223629 | 9 | FBXW2 | GTGATAAGTGCCTGTACAGAGGTGTGGC AGACTGCATGTAAAAATTTGGGCTGGCA GATAGATGATTCTGTTCAGGACGCTTTG CACTGGAAGAAG | 4.32E-05 | 0.012411705 | 9.21E-06 |
| 1833 | 3224597 | 9 | STRBP | CAAAGGCGAGTGCAGCTTTAGCTGCCTT GGAGAAACTGTTTTCTGGACCCAATGCG GCAAATAATAAGAA | 0.000148906 | 0.008661385 | 4.92E-06 |
| 1784 | 3224614 | 2 | STRBP | AGAACAAGCCTTCAGACATTTGCTATAT T | 6.13E-05 | 0.007866017 | 4.57E-06 |
| 195 | 3224665 | 4 | DENND1A | CATCTGCATGGGAACTCCACGCGGAGAC AAGGTGGGCAGAGGCGGGAGCAGCCGT GGGGGATGATGGGGTCTGATCCATGACG GACGGCCAGCCTTTCTTCTGCACCAAGA CTCTGGCAGCCCTCGCTGGGCAGCCAAG TTTGCCGCAACCTGCCTTTTCACAGACAG CTCTTTGTGTGTAATAAAATCCAGGCAA GTGGTGGGTGGCAGACCGCAGGGGAGT AGCTGAATT | 0.00877735 | 0.010604445 | 9.39E-06 |
| 595 | 3224695 | 4 | DENND1A | CCAGCTTTGCCCTTATGGTAGGTTGTCCT TGAGTCTTTTCCCGGGTCCCTGGTTTGAT GGGCTGTTGACCGTAAGAAGTACGGTTT CTAGAGCACCTACTACCGGCAGGCATGA GTTTTAAGGACTTGATATTCTTCCCAAAG AACAGTCTCTTGAGTTTCATTTCAGAAGT TTTTACCACACTCTCTTACCATCTATACT ATTTTCTTTACTTGATAGTTTTCTTTAAAT AAGACTCAGACCTGACATCTATAGCATC TTAGCCTCATCTTCAGAGATGCCATTGGT AAAATTATAGGCTTGATATACTAGTCCC AGTTTTTTCTAACATATAAAACAATTTTA AGTGTTCATCTATGAATCACCTAATGCA CTCACGTAGCCCTAATGG | 8.71E-06 | 0.010346806 | 7.49E-06 |
| 64 | 3224721 | 4 | DENND1A | GTGTACCAGCGCATCAATAACGGTGTCC CAATAGCAGCTTCTAATTAAATTTTATCA CAGTCCTGAATGCACCGCTGACCCACAC ACTCTTCCAAGTGGGTCCGATTCACAGG ATATTTGCGCAGTTCCGCAGATCTGCAG ATTTGAAGAGGTATTTATTCTCATTTCTG CCTTCCCAGTCCAGCAGAAGTTCTAATTT GTGGACGGCAGCTTTGGTAATTAACAAA GTGTGTTCTGTGAAGTGAAGCAGGAAAA CTCAGGACTGGGGAGTCTCGCTTTGGGT ATTTATA | 0.000204101 | 0.030370222 | 2.60E-05 |
| 2055 | 3225482 | 9 | MAPKAP1 | GATTCGCAAATTGACATAGCCACAGTAC AGGATATGCTTAGCAGCCACCATTACAA GTCATTCAAAGTCAGCATGATCCACAGA CTGCGATTCACAACCGACGTACAGCT | 0.000357766 | 0.007505626 | 3.36E-06 |
| 683 | 3225668 | 1 |  | CCACCATGCTATGACTGGACATCTGATT GAATCTCAAACTCACCCTCAGCGCCCAG CACCGCCAGATTCCCGCAGGCACCTCCA GAGGGGCCTGTGTCCACCTCCGTCGGCA CCAGGTGGCTGCTTTAGAG | 0.015967819 | 0.007726744 | 4.05E-06 |
| 662 | 3226162 | 9 | ST6GALNAC6 | TACCACTACTACGAGCCCAAGGGGCCGG ACGAATGTGTCACCTACATCCAGAATGA GCACAGTCGCAAGGGCAACCACCACCGC TTCATCACCGAGAAAGGGTC | 0.008619147 | 0.010328204 | 3.83E-06 |
| 235 | 3226361 | 2 | PTGES2 | AATTTTATGGTTCGGGTCACAGTAGGAA GCGGACAATGAGGCGGGAGGGCAGAGA GAACCGCAACACCTGGTGCCGGGTCGGG TCGTTTCCGGGGCTTTCAGTGGCCGGAA GTCGCGGCGCCTGTACTGACTCTAGGAA GGGCTGGAGTTGTTTTGAATGGGCGCCC | 0.000332253 | 0.01043034 | 6.55E-06 |
| 1724 | 3227198 | 9 | FNBP1 | CTCCCATCGCTTCAACGAGTTCATGACCT CCAAACCCAAAATCCACTGCTTCAGGAG CCTAAAGCGTGG | 0.019499011 | 0.006759972 | 5.10E-06 |
| 972 | 3227514 | 1 |  | TGACTGCACGGCTCAGAAAAGAATTGCA GCTCCCTTGGCGGATCCCCCAGAACCCC CTGTGATGAGCTTTGGGAACATTTTC | 0.029020011 | 0.007096129 | 5.16E-06 |
| 1145 | 3227768 | 4 | RAPGEF1 | TGGCCAGCTCGCCTTGGGAAACCACCCA TGCCATCATCGTGCATATGATCTAATGG | 0.003105755 | 0.009440612 | 3.72E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CTTTAGAGAACTAGGAACAGAGTTATTC CCCAACAAACTGACTGGGAACCTGTTCT GATGAGTATTTTAATTTGTGTGATAAAC AATCATTTTGAGAGGCTGGGGTTTGCCA TTTCCCCTTCCAAGAGGAAGTGCCTTTAC GCATTTGAAACTTGACATGCCATGAAGG TATTTTTGGAGGGCAGGGGACATTTGGG AAGTCATGCAGATTACCTAAGGCAAGTG ATACTTGCGTTTATGGTGCGTGGGGAAT CTGTAGGCACAGAAATGAGACTCAGCAG CAGAGGACAGACAGCACCTGCCTGCCTT CTGGTGGAAACTCAGTGGTGACGGGAGC TTTGCTCATTGCCTTTTTC | | | |
| 663 | 3228519 | 4 | RALGDS | AGTGGCGTGGTCAGTCACCATTGCACGC TAGCCACAGGACTATTCTCCACAGAGTC CTTCCCTCTGTCCCCTGCTGCAGAGGTGC CTGGTGATGACAGCCAGCCTGTAGGCCT TGTGCTAAAGTGTCCCTTGTATCTGCTCA GCACTCTGCAAGATAAGTGCCACTGCCA TCCTCACTTCCAGGTGGGGAAACTGAGG CACTGGAAGGGGAAGGAACTCCCACAG CTAGGTAGTGGCAGCTTGGCAATGGCGC CTCCCCGTGTGCACACAAGCCTGGGAAG GGCCAGGCACCAGGACCACATTCCTTCC AATTACAGTGGCCTTCCAACGGTCAGG | 0.012305161 | 0.00667609 | 3.78E-06 |
| 1401 | 3228844 | 4 | SARDH | GAGGGTCTGGGACGTCCTCAGGGCAGCG GAGTGACAGAAATGCAAGGTGTACCCCA ACCGCAG | 0.001647248 | 0.007061409 | 3.19E-06 |
| 1195 | 3229079 | 9 | BRD3 | ACCCAATGGATATGGGGACTATTAAGAA GAGACTAGAAAATAATTATTATTGGAGT GCAAGCGAATGTATGCAGGACTTCAA | 0.004454644 | 0.010177232 | 9.25E-06 |
| 1325 | 3232245 | 1 | | TCGTCTAAGGTTTCCAAAAGAAGCATCA GCCCCAGTCAGAGAAACCCCAATGTCCC AGTCCCTCGTAGGAAGGCAGTGT | 0.000288505 | 0.006672542 | 4.35E-06 |
| 383 | 3233209 | 4 | NET1 | TGTAGTGAGTTGTTGACCCCAGATACAG TTTCTTACAGATGTGCCATGTTGCATCTC CTGATGAATATGAGACAGATTTGATCCC ACAACTCTGTTCTACAAACACATAAGGC GTTA | 0.000490372 | 0.014676043 | 1.08E-05 |
| 1600 | 3233220 | 6 | | CCATGAAATGGCTTGATGTATTCTAGAC TACTGAAAGAAAACCACTTCAAAGATTT TGTTGAAAGTTTTAGTGTTGTCTGAAATG CAAGAGGGAAGGTGATTGGTAGTGAGTT AAAAGAAAAGAGAGGAAAAGAGAGTA GTTTTGTCTTCAAGTAAAATGTCTGGTTG TGCCAGACATTTCACAAGTGTGAAAGGA GATAGGAGAAGCTCAACTTGAGGGCGTG TAGTAAGTTGTAGAAGGCTCGAGGGGAC GTGGACTTATTTGCCTTG | 0.005404779 | 0.011800116 | 1.59E-05 |
| 1768 | 3233333 | 4 | C10orf18 | GCCAATCATGAAGGACCGCGTGCTGTAT GACTCTGTTTATAGGAAATGGTCTGGAA TAGGCAAATCTGTAGAGACCGAAAGTAA ATTATGGTTTCCTAGGCCTAGGAACCAG TGAGGGGTGAGGAGGATAGCTAAGGGG TAGAAGGTTTCTTTGGGGATAATGAAAA TACTCTAAAATTGATTGTGGTGAAGGTT GCACAATTCTGTGGATATACTAAGCACA ATTCTGTGGATATACTAAAAGCAATTGA ATTGTACACTTTATGTGGGTGAATTGTAT GCCGTATGAATTATATCTCAACATTGTAT TAGAAAATAAAATTAATGAAGCATAGAA GTTACGGAGAACTACTG | 0.002531721 | 0.006884206 | 4.90E-06 |
| 1219 | 3233453 | 9 | FBXO18 | TGAGACGGTTTAAGCGGAAGCATCTTAC TGCCATTGACTGCCAGCATTTGGCTCGG AGTCACTTGGCTGTGACCCAGCCCTTCG GTCAAAGATGGACAAACAGAGATCCGA ACCATGGTCTCTATCCTAAACCGAGAAC A | 0.003781407 | 0.008479823 | 5.51E-06 |
| 1791 | 3233454 | 4 | FBXO18 | TGTCCAATCTGTCACTAGGTCCATGTGTC ATTGTTTTCCTTCCAAAATATTCCTTCAT | 0.006245159 | 0.006903255 | 5.00E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CCTGAGCTCTTTGTCACCTAGGACCTGG ACTACTACAGTAACCTTGCTCCTTGACTT CAGA | | | |
| 678 | 3237409 | 9 | CACNB2 | AAGGATCTGATGGAAGCACGTCATCTGA TACTACCTCAAATA | 0.006442959 | 0.009187946 | 6.21E-06 |
| 1367 | 3238738 | 9 | ARMC3 | CAGAGCCAGCTTCTGGACGAAATACTGT TCTCAGCAAAAGCGCCACCAAAGAAAA AG | 0.001558259 | 0.006682987 | 5.03E-06 |
| 219 | 3238928 | 1 | | CCTGCTAGTGGCACATCCATCAGTACAT GAACTGAATATGTCACAGAGTGTATCAA AGCTAAGGTAGGTGCCTGTCCCACCATC AGTTGAATGAGAAGGTTTCTGATATCAG AAATTGGGCTACCCTGCTTTGCCAAGAC TCTCTTTTCCAATCTCTCAAAGGCAGATA ATAACACTAATGGACAATGTGGCCATGA GCATTAAAACAAATCATTAGGCTGGAGG CTTCTCATCAGTGCTTGAGGGCAATTTCA CCACCTGGGGCTTTC | 0.048552369 | 0.014256799 | 5.10E-06 |
| 1264 | 3242177 | 5 | PARD3 | AGTCTGTCTGGGTCAAGTCAATGGAAAG AG | 0.044114238 | 0.007389697 | 4.64E-06 |
| 609 | 3243790 | 1 | | GCCTCATGGGCGCAAACACTCGGGAGCA CACGTGGA | 0.004987466 | 0.009165899 | 5.63E-06 |
| 706 | 3245925 | 4 | WDFY4 | GGGCCCACTGGCGACAGCCCAGAGTCCA CTGGAGCACCCCATCTGCCGCAGGACAG CTCGCAGCCCTGTGGCAGCTTTGCTGAC CGCCTATCACCTGGGA | 0.000481864 | 0.010700417 | 3.49E-06 |
| 983 | 3245926 | 4 | WDFY4 | ATGAAGCAAGGAAACGGCTGGTACTCTG GGAAG | 0.001628328 | 0.007000229 | 3.48E-06 |
| 1301 | 3246011 | 3 | RP11-507P23.3 | AGGTCTCAATCAACCACCATATGTGTGA GTGAAGGAACCTTCAGATAATTTTGCTT CCCAGACTTCAAGTCTTTCAGCTGGGGT CCAAGCATCACAAGGCAGAGACAAGC CCTCCTGGAATTCCCCACCCACCGTGAG CATAAGAAAACT | 0.003133247 | 0.007051697 | 5.62E-06 |
| 906 | 3247960 | 1 | | GGCAGAGAGCAAGCCGGGAAGTTGGTG AACTTGGAATTTGATGAGCTCCTTGT | 0.008412239 | 0.007147019 | 6.25E-06 |
| 846 | 3248990 | 1 | | TTTGTATTCGTTGCTCCCTCAGAGGTGGA GGTGAGGGGAAAGTGAAGTGTAGTGGTT CCACTCTGATCACAAAATAAACTCCTGG GTTGACGCCTCACCCGCGGTTTGATGTTC AGAGCACACAGCGCCCGCCGCCTGAGTT AGCCTGAATTAGCAGTCCCGCAGTAACA GCAGC | 0.001314314 | 0.007676396 | 8.78E-06 |
| 1981 | 3250089 | 9 | DDX21 | AGAAATGGCATGATTCACGACGCTGGCA GCTCTCT | 0.007597824 | 0.007720875 | 6.45E-06 |
| 1728 | 3251407 | 2 | DDIT4 | CAGAGACGACTGAACTTTTGGGGTGGAG ACTAGAGGCAGGAGCTGAGGGACTGATT CCTGTGGTTGGAAAACTGAGGCAGCCAC CTAAGGTGGAGGTGGGGGAATAGTGTTT CCCAGGAAGCTCATTGAGTTGTGTGCGG GTGGCTGTGCATTGGGGACACATACCCC TCAGTACTGTAGCATGAAACAAAGGCTT AGGGGCCAACAAGGCTTCCAGCTGGATG TGTGTGTAGCATGTACCTTATTATTTTTG TTACTGACAGTTAACAGTGGTGTGACAT CCAGAGAGCAGCTGGGCTGCTCCCGCCC CAGCCCGGCCCAGGGTGAAGGAAGAGG CACGTGCTCCTCAGAGCAGCCGGAGGGA GGGGGGAGGTCGGAGGTCGTGGAGGTG GTTTGTGTATCTTACTGGTCTGAAGGGAC CAAGTGTGTTTTGTTTGTTTTGTATCT TGTTTTTCTGATCGGAGCATCACTACTGA CCTGTTGTAGGCAGCTATCTTACAGACG CATG | 0.002001825 | 0.00976791 | 1.12E-05 |
| 1895 | 3251899 | 2 | SEC24C | AGCTGGAGCGCCGTTCTCTCCTGCTGGG ACACCGCTTGGGCTTTGGTATTGACTGA G | 0.009861702 | 0.006512534 | 6.03E-06 |
| 1279 | 3253147 | 5 | KCNMA1 | ATGCATAAAGTAGTGAACAGGCCCGGTG CTGATGACAGGACGGACTCTGT | 3.45E-05 | 0.008675527 | 4.82E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1817 | 3256044 | 9 | LDB3 | TGCCTGCATCTACCTACAGCCCGTCCCCA GGGGCCAATTACAGTCCCACTCCCTACA CCCCCTCCCCTGCCCCTGCCTACACCCCC TCCCCTGCCCCTGCCTACACCCCCTCACC TGTCCCCACCTACACTCCATCCCCAGCAC CAGCCTATACCCCCTCACCTGCCCCCAA CTATAACCCTGCACCCTCGG | 0.002743526 | 0.00667878 | 5.31E-06 |
| 2065 | 3257391 | 9 | KIF20B | TTGAAGACATGCGAATGACACTAGAAGA ACAGGAACAAACTCAGGTAGAACAGGA TCAAGTGCTTGAGGCTA | 0.00010865 | 0.006823504 | 5.42E-06 |
| 1211 | 3258781 | 9 | TMEM20 | ATGTCCCTCGCTGATGCCACAGTTATCAC GTTTAGCAGTCCAGTGTTTACGTCCATAT TTGCTTGGATATGTCTCAAGGAAAAATA TAGCCCTTGGGATGCTCTTTTCACCGTGT TCACAATCACTGGAGTGATCCTTATCGT GAGACCACCATTTTGTTTGGTTCCGACA CTTCGGGGATGGAAGAAAGCTATTCAGG CCACCTTAAGGGAACATTCGCAGCAATT GGAAGTGCCGTATTTGCTGCATCGACTC TAGTTATCCTAAGAAAAATGGGAAAATC TGTGGACTACTTTCTGAGCATTTGGTATT ATGTAGTACTTGGCCTCGTTGAAAGTGT CATCATCCTCTCTGTATTAGGAGAGTGG AGTCTGCCTTACTGTGGGTTGGACAGGC TATTTCTCATATTCATTGGGCTCTTTGGT TTGGGGGGTCAGATATTTATCACAAAAG CACTTCAAATAGAAAAAGCAGGGCCAGT AGCAATAATGAAGACAATGGATGTGGTC TTTGCTTTTATCTTTCAGATTATTTTCTTT AATAATGTGCCAACGTGGTGGACAGTGG GTGGTGCTCTCTGCGTAGTAGCCAGTA | 0.006523669 | 0.007770014 | 6.38E-06 |
| 949 | 3258921 | 4 | HELLS | GGTTAATATCAGAACCAGTATCTACT GTGTCATCTAAAACAATTTAGGAGGTTA TCTGAATTTCCTTATATATCTAGATTTTT ATCGATTTCTGTGAGTCATTTCATTTGCT GCTACTCTGGTGTTTATGCCCTTACTGTG CCCTATTTATAG | 0.003504013 | 0.009449736 | 7.75E-06 |
| 272 | 3258959 | 2 | HELLS; RP11-119K6.6 | TTCTGGCTGTACTGAAGGGACTTTCATG ATTTCTTCGTTTTTGTACTCTTAGTTTTAT AATATTGCATAGTAGCTAAGGCCTGGCT GTAGCAGTTATAAACTGTTCTGCAAGTG CGGGAAGTAATAGTTATTCCTATCTCAA GGATGTGGGGTTTAAATGGGTTAGTGCA CAAAAGGACATTTATTAAATTTAGTCAT AATCATCTCAAGGACATGGTAAGTGAAA GAGTGTACATAAAGTACTTAATGTAATG TTTGCTACTTAATGTTCAATAACTCAAAG AGACCACCACCACTACTACATTTTACTTT TATTAGTAATTAATAATAATTAATAATTA GTAATTCAGTGGTAATTAGTATACTACC AAAGAAAGTACTTGAGCAGAAGAGCCA AAATTCAAACCATAGAATCATTTTACTG TGCTTTTATTCTACCTCAAACACTAATCT CCAGGCCTTGGATAAAGGGATTATTTCT CTGAAGGGGAAAGTTATCCTCTTTTTGCC CAAGTCACACTTGTGTCATTTCTTATACT GTAAACATGTGGTTCCAATTCTGAGGTA TTTTCCCGGTTTGTAGGACCCAAAAAGA AGTTAGGCTTGAGAAATTTTAAGTGAAG AGAACAATTCAGTTCAGAGTGATTGGC TCTTCCTAAAAGCTGACATTTGACTGAA AATTTTGAGGGGAGGGAAAGAAACAAT ACCTTTTACGGCATGTAATAGGAAGAAG ACCTGGATTTTAGTTGCTGCTCTGATGTC CCAACTTGGGTAAGGCAACATAACATAA ATGTCAGTTTCTTCAGATTTGTGATGAAG CTGATAATCCATGCTCAGCTTCCTTTATG GGTCTCTTGCCTATCAAATAAGGTACAG TATGTGAAGATACATTGCAGATTATCTT ATGCATTGCTTCAGGGGATGATTAAACC | 9.61E-05 | 0.020646723 | 1.09E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1666 | 3260203 | 1 | | ATCCTTTATTATAGCCAGAGTCTAGTCTA AGGGAAGAAGGTCATTCTCTATACCAGT GAAGGCTCCATCCAAACCAGTGTT TTTTGTTGTGCCTAATAAACTGCTCTCCA CTCAATGAATATTGTTACTTGACTCCCAT TACAACTC | 0.014792007 | 0.007368352 | 7.25E-06 |
| 1616 | 3260608 | 6 | | CTTGAGAAGGTTACTGAGTGAGTTATTG GGAGTC | 0.000117217 | 0.009690655 | 4.08E-06 |
| 790 | 3260609 | 2 | SCD; AL139819.1 | GCCTAAAGTATACAACTGCCTGGGGGGC AGGGTTAGGAATCTCTTCACTACCCTGA TTCTTGATTCCTGGCTCTACCCTGTCTGT CCCTTTTCTTTGACCAGATCTTTCTCTTCC CTGAACGTTTTCTTCTTTCCCTGGACAGG CAGCCTCCTTTGTGTGTATTCAGAGGCA GTGATGACTTGCTGTCCAGGCAGCTCCC TCCTGCACACAGAATGCTCAGGGTCACT GAACCACTGCTTCTCTTTTGAAAGTAGA GCTAGCTGCCACTTTCACGTGGCCTCCGC AGTGTCTCCACCTACACCCCTGTGCTCCC CTGCCACACTGATGGCTCAAGACAAGGC TGGCAAACCCTCCCAGAAACATCTCTGG CCCAGAAAGCCTCTCTCTCCCTCCCTCTC TCATGAGGCACAGCCAAGCCAAGCGCTC ATGTTGAGCCAGTGGGCCAGCCACAGAG CAAAAGAGGGTTATTTTCAGTCCCCTCT CTCTGGGTCAGAACCAGAGGGCATGCTG AATGCCCCCTGCTTACTTGGTGAGGGTG CCCCGCCCTGAGTCAGTGCTCTCAGCTGG CAGTGCAATGCTTGTAGAAGTAGGAGGA AACAGTTCTCACTGGGAAGAAGCAAGGG CAAGAACCCAAGTGCCTCACCTCGAAAG GAGGCCCTGTTCCCTGGAGTCAGGGTGA ACTGCAAAGCTTTGGCTGAGACCTGGGA TTTGAGATACCACAAACCCTGCTGAACA CAGTGTCTGTTCAGCAAACTAACCAGCA TTCCCTACAGCCTAGGGCAGACAATAGT ATAGA | 0.000153753 | 0.01256466 | 6.16E-06 |
| 1827 | 3261067 | 9 | TLX1 | CCTGGCCACCGGCTTGCCCACCGTGCCC TCTGTGCCTGCCATGCCGGGCGTCAACA ACCTCACTGGCCTCACCTTCCCCTGGATG GAGAGTAACCGCAGATAC | 0.000620704 | 0.007366558 | 7.93E-06 |
| 1319 | 3261680 | 9 | NFKB2 | AGGTGAAGGAAGACAGTGCGTACGGGA GCCAGTCAGTGGAGCAGGAGGCAGAGA AGCTGGGCCCACCCCCTGAGCCACCAGG AGGGCTCTGCCACGGGCACCCCCAGCC | 0.00620627 | 0.007045917 | 5.59E-06 |
| 1087 | 3262195 | 7 | USMG5 | TCACCCACCTGCCAAAGCCGCAAATTCC GCAGCTGGTGTCCTT | 1.18E-05 | 0.011314813 | 4.65E-06 |
| 1308 | 3262201 | 9 | PDCD11 | GGAGGTACAAGAAAGATCCACAAACCA GAGAAAGCTTTCCAGCAGTCAGTTGAAC AAGACAACTTATTT | 0.003266926 | 0.008070873 | 4.26E-06 |
| 714 | 3263441 | 1 | | CCCCTCGTCCCTTGCTGCTGAGTGAAATT CTGCTCCCTGCTCCCAGCTCATTTTCATC CCGTCCCACAAGCTCCCAGGTATAT | 0.000273283 | 0.011872655 | 6.77E-06 |
| 1994 | 3263816 | 9 | SMC3 | GTGACCAAGTCAGCCATCGGGGTGCTCT AACTGGGGGTTATTATGACACAAGGAAG TCTCGACTTGAATTGCAAAAAGATGTTA GAAAAGCAGAAGAAGAACTAGGTGAAC TTGAAGCAAAGCTCAATGAAAACCTGCG CAGAAAT | 2.66E-05 | 0.00676427 | 4.02E-06 |
| 2066 | 3263824 | 9 | SMC3 | CTTCAGAAGAGTATGGAGCGCTGGAAAA ATATGGAAAAGAACATATGGATGCTAT AAATCATGATACTAAAGAACTGGAAAAG ATGACAAATCGGCAAGGCATGCTATTGA AGAAGAAGAAGAGTGTATGAAGAAAA TTCGAGAACTTGGATCACTTCCC | 0.000146929 | 0.007441363 | 6.30E-06 |
| 297 | 3265208 | 9 | TDRD1 | ATGTGTGTTGCTGGGATAAAATTGCAAG CCAGAGTGGTTGAAGTCACTGAAAATGG GATAGGAGTTGAACTCACCGATCTCTCC ACTTGTTATCCCAGAATAATT | 0.011264381 | 0.012192501 | 1.62E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 2080 | 3266824 | 7 | C10orf46 | ACATCCTCTTCCATGAACAGCTTTGTGAC AGAGCTCCTGAGTGTGTGCAGCCCCCAC TGTGCTCTGAATACAGTCTCTGCAGC | 1.60E-05 | 0.006900786 | 2.85E-06 |
| 1340 | 3268609 | 9 | ACADSB | CCTTCTTAGTAGATCGTGATACTCCGGGC CTTCATATAGGGAAACCTGAAAACAAAT TGGGGCTCAGAGCTTCTTCCACCTGCCC GTTAACATTCGAAAATGTC | 0.00453157 | 0.007532844 | 4.87E-06 |
| 2072 | 3268687 | 6 | | CTCTATGGAAAGCTTTGTTTGCTTCCTAC AAATACATGCTTATTCCTTAAGGGATGT GTTAGAGTTACTGTGGATTTCTCTGTTTT CTGTCTTACAAGAAACTTGTCTATGTACC TTAATACTTTGTTTAGGATGAGGAGTCTT TGTGTCCCTGTACAGTAGTCTGACGTATT TCCCCTTCTGTCCCCTAGTAAGCCCAGTT GCTGTATC | 0.000408197 | 0.006896832 | 5.98E-06 |
| 549 | 3270603 | 1 | | ATGGCGTCGGGAAGAGCCAGGGACCCG GCTGTGCGCTTGGATCCATCACTGCTCTG GGC | 0.001587412 | 0.010264099 | 7.78E-06 |
| 1608 | 3270778 | 1 | | AAGGCCAGCACAGCGTGGTAAAGCATCA GATCTCTGGCTCTGCATGCCCCGCCGCTG AGCCTCAGCCCAAGCACACT | 3.33E-05 | 0.00732201 | 4.59E-06 |
| 2033 | 3271719 | 9 | PPP2R2D | CGGACATCATTTCCACCGTTGAGTTTAAT TACTCTGGAGATCTTCTTGCAACAGGAG ACAAGGGCGGCAGAGTTGTTATTTTCA GCGTGAACA | 1.57E-05 | 0.006604433 | 4.28E-06 |
| 752 | 3271859 | 9 | JAKMIP3 | GACAAGCTGTTAAGATTCCGGAAGCAAA GA | 0.007566793 | 0.009133827 | 1.66E-06 |
| 1317 | 3273492 | 2 | LARP4B | GTGCAGAGCGCTGTGTTAACCACAAAC GAGACACTCTCCCACTCAGTGCGAGGGC GAGCCGCTGGTTAGGAGCTTGCAGTGTC TGAGGCCTGTGGGATCCTCAAGTTGGTT TTCTTCTGTGAGTTGGATTCTCCCCCTCT TGAAAAAAATCGATTTTTCAGGATTTA ATTAATACAAACCTTATTTTAGGTTGGTG CTAACTGGAGGTGATGCATAAGTCTGA TTTTTTTTTCCAAGATAGAAAAAGCATTT ATCCTAACAAATTGGTATTTTTATTAAG CCTCCATGTGGCTCTGAATGCAAGCTAT ATATAGTGAGTTTTTCTAAATTAAGGGA ACTCTGCTTTTTTTTTTTTTTTTAAGTAA CTGGTCTGTAAGTGCATATCTCTAGAAC GTCCCCGCAGATGAATGAGGGCCAGTGG CCTTGGCAGAGGCAGGTGTGGCCTCGTA GAGGCAGTGCTGGCCGCGCCAGGGCATC AGTGCTGATGTGGGAGCTGTGCTTCCAC CTAAGCCGTTGGTAGGGGACTGTGGCAT TTAAGAATGTAGAGAGCGCATCCTTTTT GATCTCCTGGGCGGAGTGAACCTGCAGG GGCCACCCCAGAAACCTTGGTTCTGATG CACTGCAAGCAAGTAACCAGCTTCTCAC TCCAGTTTCAAGTGGCTATTATGTAATAT AAATTCAAAGCACATTGTGAATAGAACC TACATGAAAACATACACTTTGTTGCCCA CTGACATGTTA | 0.000163031 | 0.008013788 | 4.84E-06 |
| 1831 | 3273589 | 7 | IDI2-AS1 | ATCCAGAGCTCGCTGGGCATCCACCCGG TGGGAGACAGGCCAGCACGACCAAGTG GCCAGCACACCA | 0.045476068 | 0.007550062 | 5.19E-06 |
| 1134 | 3273785 | 9 | ADARB2 | TAAAGTAAGCATATTGTCAACCTTCCTC GCTCCTTTCAAGCACCTGAGTCCTGGCAT CACAAACACGGAGGATGACGACACCCT | 0.041003559 | 0.007815956 | 5.26E-06 |
| 1465 | 3274485 | 1 | | AAGTTGGCCACAAGCACCGTGAGTATGG CGTGGGTCGCCCTCTTCCCTGTCTCCCTG CTGGACACCCACCCACCCCTTAGCGCCT GCAGAGAAGTCCCCCAGGAGTCCAGGC CTGGGTCCCTGTGGCCCTGGGGGTTTG TGGCGACCCCAACACGAGCTCTCTGCGA CTGCACG | 0.015428709 | 0.009244812 | 1.10E-05 |
| 1682 | 3276980 | 1 | | TGATCCATTAAGTGAGCTGGGGTTTGAA GTTCAGAGGCGTTTGGTGGAACACGTGG | 0.024015481 | 0.007284984 | 4.12E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1116 | 3277460 | 1 | | ACGGGCTAATAAGACGCTGTGGATCCAT GGGAAAAGGATGGGCACGA GGCCTTCGATGCTGGCACTGTCTTGGCG CCTGGCTCTACATCATGACAGTGTGACA AGGAAGACAGGCTGCCTGCTGACCATCT TTGGGACAGAGAAGCTTAATATC | 8.36E-05 | 0.007347087 | 4.76E-06 |
| 468 | 3280630 | 2 | NEBL | TGGTAGACCTCTGGGATCCTTTTCTGTTC ACTCACACACCACTGAGATAAGGAGTGA AGTGTGGGCTAAATAGGGCTGAGGCTTG GGCAAGGGCATTTCTGCCAGAGCACCAG AGACGTCAGCATCTCAAGGGCACTGTGG TATGGAAAAGGACGCCACATGAGTAAAT TTTA | 0.00349637 | 0.007402615 | 5.15E-06 |
| 1232 | 3281132 | 4 | PIP4K2A | TGTGACCAGCAGTACAGAGAACTATA CTGTGTTTGCCAAAGGGGATT | 0.000412342 | 0.008458062 | 6.54E-07 |
| 1093 | 3281422 | 7 | KIAA1217 | CGTTTCTGCCCGACTTGCAGTTTCAGGGC ATGCCAGGACTGCAGCACCCTCTCCGTC CTCCCCCGGAAACGACTTTCAATTCACCT GGAGGCTCTCGAGGCTCCCCCGCGGGCG GGTAGCGTGACAGTGGGTGCAGAGGAG AGGGAGGAGCGCGGGAACGGCGGCGGC CCCAGTGCGCCTCCCGCTTGCTTGGCGA GAA | 0.000272577 | 0.00776324 | 3.40E-06 |
| 926 | 3281437 | 1 | | TGCCTTTAAAAAGCTGCGCTAGAGGTTT AGGGGGGAAGAGTGGGATAGACGGTGT GGGAGAGTTGGTTTCCACGCTCCTGTAG | 0.00877735 | 0.010032762 | 6.39E-06 |
| 2017 | 3282231 | 9 | YME1L1 | TTTAAACCCAATGAAGGAGTTATCATAA TAGGAGCCACAAACTTCCCAGAGGC | 4.43E-06 | 0.006735584 | 3.51E-06 |
| 1970 | 3283993 | 2 | KIF5B | TACTGTGCGTAACTCTCAGTTTGTGCTTA ACTCCATTTGACATGAGGTGACAGAAGA GAGTCTGAGTCTACCTGTGGAATATGTT GGTTTATTTTCAGTGCTTGAAGATACATT CACAAATACTTGGTTTGGGAAGACACCG TTTAATTTTAAGTTAACTTGCATGTTGTA AATGCGT | 0.000784922 | 0.007852174 | 3.97E-06 |
| 1820 | 3283995 | 2 | KIF5B | AGGACATGGTATCAAGCAGTCATTCAAT GACTATAACCTCTACTCCCTTGGGATTGT AGAATTATAACTTTTAAAAAAAATGTAT AAATTATACCTGGCCTGTACAGCTGTTTC CTACCTACTCTTCTTGTAAACTCTGCTGC TTCCCAACACAACTAGAGTGCAATTTTG GCATCTTAGGAGGGAAAAAGGACAGTTT ACAACTGTGGCCCTATTTATTACACAGTT TGTCTATCGTGTCTTAAATTTAGTCTTTA CTGTGCCAAGCTAACTGTACCTTATAGG ACTGTACTTTTTGTATTTTTGTGTATGTT TATTTTTTAATCTCAGTTTAAATTACCTA GCTGCTACTGCTTCTTGTTTTTCTTTTCCT ATTAAAACGTCTTCCTTTTTTTTTCTTAA GAGAAAATGGAACATTTAGGTTAAATGT CTTTAAATTTTACCACTTAACAACACTAC ATGCCCATAAAATATATCCAGTCAGTAC TGTATTTTAAAATCCCTTGAAATGATGAT ATCAGGGTTAAAATTACTTGTATTGTTTC TGAAGTTTGCTCCTGAAAACTACTGTTTG AGCACTGAAACGTTACAAATGCCTAATA GGCATTTGAGACTGAGCAAGGCTACTTG TTATCTCATGAAATGCCTGTTGCCGAGTT ATTTTGAATA | 5.94E-05 | 0.008521667 | 5.86E-06 |
| 1621 | 3284211 | 9 | ITGB1 | AGGAATGTTACACGGCTGCTGGTGTTTT CCA | 1.31E-05 | 0.01042158 | 1.05E-05 |
| 1648 | 3284305 | 9 | NRP1 | GAGCACGCCAGGATACGAAGGTGAAGG AGAAGGTGACAAGAACATCTCCAGGAA GCCAGGCAATGTGTTGAAGACCTTAGAC CCCATCCTCATCACCATCATAGCCATGA GTGCCCTGGGGGTCCTCCTGGGGGCTGT CTGTGGGGTCGTGCTGTACTGTGCCTGTT GGCATAATGGGATGTCAGA | 0.006429597 | 0.011846842 | 1.13E-05 |
| 1762 | 3284324 | 9 | NRP1 | AAAGCCCACGGTCATAGACAGCACCATA CAATCAG | 6.28E-06 | 0.008755286 | 5.38E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 110 | 3289058 | 9 | TIMM23 | TCTGACAGGACTAACACTTACCAGCCTCTATGCACTATATAATAACTGGGAGCACATGAAAGGCTCCTTGCTCCAACAGTCA | 2.58E-05 | 0.018804344 | 1.65E-05 |
| 673 | 3289482 | 2 | A1CF | AACAGTGCTGTGCCAAAAACCTGTGGATT | 0.04509417 | 0.00800955 | 7.31E-06 |
| 1757 | 3290799 | 9 | CCDC6 | TGTCTGCACAAGGATTAAGACCTCGCACTGTGTCCAGCCCGATCCCTTACACACCTTCTCCGAGTTCAAGCAGGCCTATATCACCTG | 1.95E-05 | 0.009372214 | 7.09E-06 |
| 1999 | 3290817 | 9 | CCDC6 | AAGCCGAACTAGAACAGCATCTTGAACAAGAGCAGGAATTTCAGGTCAACAAACTGATGAAGAAAATTAAAAAACTGGAGAATGACACCATTTCTAAGCAACTTACATTAGAACAG | 6.16E-06 | 0.007807125 | 6.97E-06 |
| 920 | 3292591 | 2 | PBLD | CTTGATATATGGCTTGAGAATGATAATGTAAAAGGAATTCTTCTCTTACTTCAATAAAATGGGTTTTAACATAACTTTAAATTCAGTTAAATATACAATATTGAATACCTATAGTTGACTTTGGGATGGGGACTTTTTCAAGTCATTAAGAGTGTTTGTTTAAGGTGATCTCATTGATGGTAGTTCTCAGCCGTCTCAAAAACTGCAAGCTAATCAGTCAGACATTC | 0.000264928 | 0.00979269 | 6.69E-06 |
| 1732 | 3292766 | 4 | SLC25A16 | GCCGCACAATTATAGCTCTCCGTGACCTCCAACTGTTGGCTCACGTCATCCTCCAGCCTTAGTCTCTGAGTACTGAGGCACACCACCATGCCTTGCTAATTTTTTTTTTCTTTGAGATGGAGTCTCGCTTTGTCGCCCAGGCTAGAGTGCAATGGTGTGATCTCGGCTCACTGCAACCTCGGCCTCCTGGGTTCAAGGGATTCTCCTGCCTTAACCTCCCAAATAGCTGGGACTACAGGCGCCTGCCACCATGCCTTGCTAATTTTTTTGTATATTTGATAGAGACGGGGTTTCACCATGTTGGCCAGGCTGGTGTCGAGCTCCTGACCTCAGGAGATCTGCCCGCCCCGAGCTGCCAAAGTGCTGGGATTGCAGGCATGAAGCACTGCGCCCAGCCGATTTTAAAAAATTTTTTGTAGAGATGAGGTCTCACTGTGTTTCCCAGGCTGGTCTCAAAACTCCAGTCTCAAGTAATTTTTCTACCTCAGCCTCCGAAAGTGCTGGGATTACAGGTGCGAGCTACTGTGCCTGGCCTGTTATTCACCTTTTTATAAAAGGAGCAACCCATTTTTTCAAGTCATTACTAGATGTACAGTATTGTAGAGAAGTCTATATTATTGCTTTAGAAGCATGCCAAGCTCGAAGGGCTGGCCTGGACTCTGACCTATGCTAAAGCCCATGTATGCACTTTATTCTACTTTCATCTATACTTTTCCCCAGTGGCACATGGTAGGGTCGAAATACA | 0.000164774 | 0.006568018 | 1.05E-06 |
| 193 | 3293219 | 9 | TYSND1 | GCATAATCACCAGCAACACCCGGGACAATAA | 0.037563396 | 0.014951746 | 2.22E-05 |
| 1413 | 3293539 | 2 | PCBD1 | GAATTTAGACCTTTTCCCTGCACCACTCTCTTCATCCTGGGGGCTCTGTTACACTAATTTGAATAAACTCTCCCCTTTCTTTGCAACTTCCCAGCAACAATAATGATTTTCTTGCCAGGCCGTCTCTTGCTCCCTAATTCATTTCCCAGGAAGCTGTGATACAGGGTGAAATAAAGTC | 0.00020953 | 0.012455715 | 5.62E-06 |
| 905 | 3293767 | 2 | PSAP | CTGCTGGTGGCTTGGGACATCAGTGGGGCCAAGGGTTCTCTGTCCCTGGTTCAACTGTGATTTGGCTTTCCCGTGT | 6.74E-06 | 0.014379385 | 1.31E-05 |
| 1194 | 3294169 | 2 | P4HA1 | TTTGAGCATCCAGTTTTAGTATTTCACTACATCTCAGTTGGTGGGTGTTAAGCTAGAATGGGCTGTGTGATAGGAAACAAATGCCTTACAGATGTGCCTAGGTGTTCTGTTTACCTAGTGTCTTACTCTGTTTTCTGGATCTGAAGACTAGTAATAAACTAGGACACTAACTGGGTTCCATGTGATTGCCCTTTCATATGATCTTCTAAGTTGATTTTTTTCCTCCCAAGTCTTTTTTAAGAAAGTATACTGTATTT | 3.50E-05 | 0.008388232 | 5.05E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 884 | 3294190 | 9 | P4HA1 | TACCAACCCCTCTCTTTTCTTTTAGCTCCTCTGTGGTGCCTGAACATCAGAGAGCTAATGGTAACTTAAAATATTTTGAGTATATAATGGCTAAAGAAAAAGATGTCAATAAGTCTGCTTCAGATGACCAATCTGATCAGAAAACTACACCAAAGAAAAAAGGGGTTGCTGTGGATTACCTGCCAGAGAGACAGAAGTACGAAATGCTGTGCCGTG | 0.000151311 | 0.012053017 | 9.96E-06 |
| 1767 | 3294612 | 9 | USP54 | AAGCATGTTTGGTGAGCTGCTGCAGAATGCCAGCACCATGGGGGATCTGCGGAACTGTCCA | 0.002152759 | 0.006663838 | 5.69E-06 |
| 1582 | 3295307 | 7 | SAMD8 | TAGTCCGCATTATTTAACTGACTGGTTCTAAGGATAAGTTCTGATTTCAAAGGATACAAATAAATAGAGCTAGAAGTTCTATTTTTGCCCTTGCAATTCTGGTCAGAAAACTATGGAGAGGATAGCCACATAAAGAATTCTTGCAGCACAGCCACGAAAGGTTTC | 7.16E-05 | 0.008856807 | 3.98E-06 |
| 1502 | 3295752 | 5 | C10orf11 | AAGCGGCAGAGTCACCCAGAGCCTTTGCTCAGCGGAGCTCAGGCTGACTCTCCTTCTGAACTCAGTTCAAACCCTCACTCCTCTGAACACCCTCAGCCGCCGCACAGGGAGCTCCAGGGCTCTTGGGTCTTTCACAGTCCTC | 0.003914828 | 0.008579333 | 3.46E-06 |
| 177 | 3296861 | 8 | ZMIZ1 | GCCCTGTGTAACCAGCCTGTCCTCACACCCACCAGGAGGAGGAGTCGGCACTGGTTAACCCTCTGGTCTACCAGGCCCGGTTCCCAGGTTGCAGCAGGGA | 0.000850201 | 0.017485614 | 1.56E-05 |
| 1341 | 3297947 | 5 | NRG3 | ACCCTTGGTTGGCTCTCCGGCATTCCAGCTGCAGCTGCTGGGGCTGGCTGCAGGCACGTCTGACTGTTCTCCCCTTTGGAGTAGACAGGGTTGTTCTGGCTGTCCCATGCATTGCCTTTCAATA | 0.014905986 | 0.006924227 | 7.73E-06 |
| 392 | 3298214 | 1 | | TCTGCCTCAGGCATATTCGGAGTCTCATGGGGGTATCTGTGAAGAAGACGAGCACAAGAAAGCCTAAGTT | 0.000954268 | 0.009857566 | 6.07E-06 |
| 839 | 3298765 | 9 | WAPAL | CTGCACCACCATCCAAAGTGATAAAAACTGTGACAATACCTACTCAGCCCTACCAAGATATAGTTACTGCACTGAAATGCAGACGAGAAGACAAAGA | 0.023239041 | 0.007619348 | 8.04E-06 |
| 1856 | 3301491 | 4 | SORBS1 | GGATTTTGGACAAGGGCTGGGCCAGGCACAGCACTGTGTTCTGACCCGTTACGAAGAGGTA | 0.020694087 | 0.006725547 | 5.24E-06 |
| 2018 | 3301871 | 9 | TM9SF3 | TATTATGTCTATGGCTTCATGATGCTGGTGCTGGTTATCCTGTGCATTGTGACTGTCTGTGTGACTATTGTGTGCACATATT | 0.000358678 | 0.010592662 | 6.42E-06 |
| 602 | 3301947 | 9 | PIK3AP1 | GTGAGTGGACTGGTGCCAAGCATGTCCCA | 0.040239182 | 0.009496091 | 6.27E-06 |
| 407 | 3302849 | 2 | HPS1 | GACATCTGTCTTAGGCTCCAGTGGACCCCCGTGCCTCCTAAGGCTTGAGTGCAGGTACCCGTGTTCCTAGAGCACAGGACGCTGTCTGCGGCTCCCCATCTTCCCTGCCAGCTCCAGCCTGAACTCAAGGATTGTTAAGACCACTCCACTGATCCCTAAAGCTGTT | 0.000475873 | 0.011980131 | 1.06E-05 |
| 1940 | 3303460 | 6 | | CAGACTTCTGCTTTGATGACTGAGCTACAGGGACAGGAGTGGTCCAAGGTTCTCAAATTCTGTTTTTGTTTTTTCCAGACTTCTATACTATTGTCTGCCCTAGGCTGTAGGGAATGCTGGTTAGTTTGCTGAACAGACACTGTGTTCAGCAGGGTTTGTGGTATCTCAAA | 0.000933891 | 0.006757907 | 5.65E-06 |
| 108 | 3303461 | 6 | | CATTTCCAAGGGGTAGGTGCACAGGTCAACAGAACTAAACTACAGTGATCTTCCCTTAGATCCTTTTCTACTGAGGTGAATAGCTCAAAAGACAAGGATGCCTTTAGTCCAGGCTAACCCCTGTAGCCTCTACGCAATTAACACAGA | 6.24E-07 | 0.02895629 | 2.30E-05 |
| 597 | 3304424 | 4 | ACTR1A | TGGATCAACATTCCTGTCAAACTTAAAACTGTCTTTGTGACTATATGGACCTAAATGCAGGCTTCAGAAGTTCAACAATAAGCTAAGCATTTGTTTGTTTTTGCTTTGGATGT | 0.004749446 | 0.008965086 | 8.27E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 125 | 3305521 | 5 | SORCS3 | TGTGCTGCTTCAGCCCCCTTTAAAAAAA AAAAAAGAGAGAGAGAGATACTTTAAA CACACAGAAAAATTCGGTGTGGTATATA ACAAGCACCCAGGTAGCATGTGTCTA AGGAACAAGTCCTATTTGATGAAGATAC CTCAGGGAGCCTGGGAGCCTATGGAACC AACAGTGCCCTCGACTCTGTCCTTTCCAG GATGCCACTGCACACTGC | 0.002324635 | 0.016042517 | 9.05E-06 |
| 1575 | 3306389 | 8 | ADD3 | GGAGGAGGTGGTAGCGGACTGACTGAGT GGG | 0.04624829 | 0.00697595 | 7.55E-06 |
| 2038 | 3306415 | 8 | ADD3 | GTAATCAGAAAGGTGATAAGGTTTACTG ATTTACTGCAGAACTGGAATCTCCAATG GGAATTAGTGCCCTCTGG | 0.000862602 | 0.00712363 | 4.55E-06 |
| 667 | 3306762 | 4 | BBIP1 | AGTGTCACATAGCAGGCTTAATAGCTAA ACATCTGCAGCTATTGTGTTCCGTATTAT CTCATTTACTGTCTTTTACTATATGCTTTT TCATGACATCCAGTAAAAGGATAACAAA TGAAACATTGTTTCTTATACCTAAAATTG CCTATTAATTAGCTAATTCCTAAAATTCC TAATTACAATATGAATTTTTTTTAAGAGA CAGGTTGTCACTCTGCCACCCAGGCTTG GGTACAGCTGGCACAACCGTAGCTCACC GCAGCCTTGAACTACTGGGCTCCTGCCC TAGCCTACTGAT | 0.001080374 | 0.007248372 | 4.19E-06 |
| 759 | 3307486 | 1 | | CAGTCGGGCTGGGAGAAACATATGGTGC CACAAATATCCCTTTTCCAA | 0.005416181 | 0.008128483 | 3.67E-06 |
| 69 | 3308170 | 1 | | ATGGAGTGGACGCTAGCAGCCAACAGA AGGAAAGCAGGCTCCCGCTGCTCCAGCC ATTTCTGCTATGCTTACCTGCTGACTCCC GGGACAGATATCTTGCTGCCTTTGAGGT TAATTCACCAAACTCTGAACTGTCTGAA TTCTGTGGAAGCAGAATATATTGAGGTC CTGACCACGGTGTCCAGCCCTGCTGTAG AACTATGTGGATCA | 1.05E-05 | 0.037128898 | 3.04E-05 |
| 131 | 3309791 | 9 | MCMBP | GTACCATCACTGAACGAAGTTCCCCTTC ATTATTTGAAACCTAATAGTTTTGTGAAA TTTCGTTGCATGATTCAGGATATGTTTGA CCCTGAGTTTTACATGGGAGTTTATGAA ACGGTTA | 1.23E-05 | 0.026269881 | 2.80E-05 |
| 843 | 3309876 | 1 | | AGCCATCCTAGAAGGGCTCATGCCAGTC TCTTGGTTGCAGAGCCCCGGCTT | 0.024015481 | 0.008960388 | 5.20E-06 |
| 1350 | 3310831 | 1 | | CCCAGGACAAGTTCTGTGGGCATCCTTC GAAAATGAAAGCACCGTTACAACACACC ACTGATCAAGGGGAAAGTGCCTTTGTAC TCAATGGCGCAATTGGTA | 0.000802243 | 0.006806731 | 3.45E-06 |
| 53 | 3312502 | 9 | MKI67 | CAGAAGAGTGCGAAGGTTCTCATGCAGA ATCAGAAAGGGAAAGGAGAAGCAGGAA ATTCAGACTCCATGTGCCTGAGATCAAG AAAGACAAAAAGCCAGCCTGCAGCAAG CACTTTGGAGAGCAAATCTGTGCAGAGA GTAACGCGGAGTGTCAA | 4.20E-06 | 0.060126952 | 7.13E-05 |
| 1716 | 3312508 | 9 | MKI67 | GGAGAACTCTTAGCGTGCAGGAATCTAA TGCCATCAGCAGGCAAAGCCATGCACAC GCCTAAACCATCAGTAGGTGAAGAGAAA GACATCATCATATTTGTGGGAACTCCAG TGCAGAAACTGGACCTGACAGAGAACTT AACCGGCAGCAAGAGACGGCCACAAAC TCCTAAGGAAGAGGCCCAGGCTCTGGAA GACCTGACTGGCTTTAAAGAGCTCTTCC AGACCCCTGGTCATACTGAAGAAGCAGT GGCTGCTGGCAAAACTACTAAAATGCCC TGCGAATCTTCTCCACCAGAATCAGCAG ACACCCCAACAAGCACAAGAAGGCAGC CCAAGACACCTTTGGAGAAAAGGGACGT ACAGAAGGAGCTCTCAGCCCTGAAGAAG CTCACACAGACATCAGGGGAAACCACAC ACACAGATAAAGTACCAGGAGGTGAGG ATAAAAGCATCAACGCGTTTAGGGAAAC TGCAAAACAGAAACTGGACCCAGCAGC AAGTGTAACTGGTAGCAAGAGGCACCCA | 0.004061321 | 0.007855735 | 5.63E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AAAACTAAGGAAAAGGCCCAACCCCTA | | | |
| | | | | GAAGACCTGGCTGGCTTGAAAGAGCTCT | | | |
| | | | | TCCAGACACCAGTATGCACTGACAAGCC | | | |
| | | | | CACGACTCACGAGAAAACTACCAAAATA | | | |
| | | | | GCCTGCAGATCACAACCAGACCCAGTGG | | | |
| | | | | ACACACCAACAAGCTCCAAGCCACAGTC | | | |
| | | | | CAAGAGAAGTCTCAGGAAAGTGGACGT | | | |
| | | | | AGAAGAAGAATTCTTCGCACTCAGGAAA | | | |
| | | | | CGAACACCATCAGCAGGCAAAGCCATGC | | | |
| | | | | ACACACCCAAACCAGCAGTAAGTGGTGA | | | |
| | | | | GAAAAACATCTACGCATTTATGGGAACT | | | |
| | | | | CCAGTGCAGAAACTGGACCTGACAGAGA | | | |
| | | | | ACTTAACTGGCAGCAAGAGACGGCTACA | | | |
| | | | | AACTCCTAAGGAAAAGGCCCAGGCTCTA | | | |
| | | | | GAAGACCTGGCTGGCTTTAAAGAGCTCT | | | |
| | | | | TCCAGACACGAGGTCACACTGAGGAATC | | | |
| | | | | AATGACTAACGATAAAACTGCCAAAGTA | | | |
| | | | | GCCTGCAAATCTTCACAACCAGACCCAG | | | |
| | | | | ACAAAAACCCAGCAAGCTCCAAGCGAC | | | |
| | | | | GGCTCAAGACATCCCTGGGGAAAGTGGG | | | |
| | | | | CGTGAAAGAAGAGCTCCTAGCAGTTGGC | | | |
| | | | | AAGCTCACACAGACATCAGGAGAGACTA | | | |
| | | | | CACACACACACACAGAGCCAACAGGAG | | | |
| | | | | ATGGTAAGAGCATGAAAGCATTTATGGA | | | |
| | | | | GTCTCCAAAGCAGATCTTAGACTCAGCA | | | |
| | | | | GCAAGTCTAACTGGCAGCAAGAGGCAGC | | | |
| | | | | TGAGAACTCCTAAGGGAAAGTCTGAAGT | | | |
| | | | | CCCTGAAGACCTGGCCGGCTTCATCGAG | | | |
| | | | | CTCTTCCAGACACCAAGTCACACTAAGG | | | |
| | | | | AATCAATGACTAACGAAAAAACTACCAA | | | |
| | | | | AGTATCCTACAGAGCTTCACAGCCAGAC | | | |
| | | | | CTAGTGGACACCCCAACAAGCTCCAAGC | | | |
| | | | | CACAGCCCAAGAGAAGTCTCAGGAAAG | | | |
| | | | | CAGACACTGAAGAAGAATTTTTAGCATT | | | |
| | | | | TAGGAAACAAACGCCATCAGCAGGCAA | | | |
| | | | | AGCCATGCACACACCCAAACCAGCAGTA | | | |
| | | | | GGTGAAGAGAAAGACATCAACACGTTTT | | | |
| | | | | TGGGAACTCCAGTGCAGAAACTGGACCA | | | |
| | | | | GCCAGGAAATTTACCTGGCAGCAATAGA | | | |
| | | | | CGGCTACAAACTCGTAAGGAAAAGGCCC | | | |
| | | | | AGGCTCTAGAAGAACTGACTGGCTTCAG | | | |
| | | | | AGAGCTTTTCCAGACACCATGCACTGAT | | | |
| | | | | AACCCCACGACTGATGAGAAAACTACCA | | | |
| | | | | AAAAAATACTCTGCAAATCTCCGCAATC | | | |
| | | | | AGACCCAGCGGACACCCCAACAAACAC | | | |
| | | | | AAAGCAACGGCCCAAGAGAAGCCTCAA | | | |
| | | | | GAAAGCAGACGTAGAGGAAGAATTTTTA | | | |
| | | | | GCATTCAGGAAACTAACACCATCAGCAG | | | |
| | | | | GCAAAGCCATGCACACGCCTAAAGCAGC | | | |
| | | | | AGTAGGTGAAGAGAAAGACATCAACAC | | | |
| | | | | ATTTGTGGGGACTCCAGTGGAGAAACTG | | | |
| | | | | GACCTGCTAGGAAATTTACCTGGCAGCA | | | |
| | | | | AGAGACGGCCACAAACTCCTAAAGAAA | | | |
| | | | | AGGCCAAGGCTCTAGAAGATCTGGCTGG | | | |
| | | | | CTTCAAAGAGCTCTTCCAGACACCAGGT | | | |
| | | | | CACACTGAGGAATCAATGACCGATGACA | | | |
| | | | | AAATCACAGAAGTATCCTGCAAATCTCC | | | |
| | | | | ACAACCAGACCCAGTCAAAACCCCAACA | | | |
| | | | | AGCTCCAAGCAACGACTCAAGATATCCT | | | |
| | | | | TGGGGAAAGTAGGTGTGAAAGAAGAGG | | | |
| | | | | TCCTACCAGTCGGCAAGCTCACACAGAC | | | |
| | | | | GTCAGGGAAGACCACACAGACACACAG | | | |
| | | | | AGAGACAGCAGGAGATGGAAAGAGCAT | | | |
| | | | | CAAAGCGTTTAAGGAATCTGCAAAGCAG | | | |
| | | | | ATGCTGGACCCAGCAAACTATGGAACTG | | | |
| | | | | GGATGGAGAGGTGGCCAAGAACACCTA | | | |
| | | | | AGGAAGAGGCCCAATCACTAGAAGACCT | | | |
| | | | | GGCCGGCTTCAAAGAGCTCTTCCAGACA | | | |
| | | | | CCAGACCACACTGAGGAATCAACAACTG | | | |
| | | | | ATGACAAAACTACCAAAATAGCCTGCAA | | | |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ATCTCCACCACCAGAATCAATGGACACT | | | |
| | | | | CCAACAAGCACAAGGAGGCGGCCCAAA | | | |
| | | | | ACACCTTTGGGGAAAAGGGATATAGTGG | | | |
| | | | | AAGAGCTCTCAGCCCTGAAGCAGCTCAC | | | |
| | | | | ACAGACCACACACACAGACAAAGTACC | | | |
| | | | | AGGAGATGAGGATAAAGGCATCAACGT | | | |
| | | | | GTTCAGGGAAACTGCAAAACAGAAACTG | | | |
| | | | | GACCCAGCAGCAAGTGTAACTGGTAGCA | | | |
| | | | | AGAGGCAGCCAAGAACTCCTAAGGGAA | | | |
| | | | | AAGCCCAACCCCTAGAAGACTTGGCTGG | | | |
| | | | | CTTGAAAGAGCTCTTCCAGACACCAATA | | | |
| | | | | TGCACTGACAAGCCCACGACTCATGAGA | | | |
| | | | | AAACTACCAAAATAGCCTGCAGATCTCC | | | |
| | | | | ACAACCAGACCCAGTGGGTACCCCAACA | | | |
| | | | | ATCTTCAAGCCACAGTCCAAGAGAAGTC | | | |
| | | | | TCAGGAAAGCAGACGTAGAGGAAGAAT | | | |
| | | | | CCTTAGCACTCAGGAAACGAACACCATC | | | |
| | | | | AGTAGGGAAAGCTATGGACACACCCAA | | | |
| | | | | ACCAGCAGGAGGTGATGAGAAAGACAT | | | |
| | | | | GAAAGCATTTATGGGAACTCCAGTGCAG | | | |
| | | | | AAATTGGACCTGCCAGGAAATTTACCTG | | | |
| | | | | GCAGCAAAAGATGGCCACAAACTCCTAA | | | |
| | | | | GGAAAAGGCCCAGGCTCTAGAAGACCTG | | | |
| | | | | GCTGGCTTCAAAGAGCTCTTCCAGACAC | | | |
| | | | | CAGGCACTGACAAGCCCACGACTGATGA | | | |
| | | | | GAAAACTACCAAAATAGCCTGCAAATCT | | | |
| | | | | CCACAACCAGACCCAGTGGACACCCCAG | | | |
| | | | | CAAGCACAAAGCAACGGCCCAAGAGAA | | | |
| | | | | ACCTCAGGAAAGCAGACGTAGAGGAAG | | | |
| | | | | AATTTTTAGCACTCAGGAAACGAACACC | | | |
| | | | | ATCAGCAGGCAAAGCCATGGACACACCA | | | |
| | | | | AAACCAGCAGTAAGTGATGAGAAAAAT | | | |
| | | | | ATCAACACATTTGTGGAAACTCCAGTGC | | | |
| | | | | AGAAACTGGACCTGCTAGGAAATTTACC | | | |
| | | | | TGGCAGCAAGAGACAGCCACAGACTCCT | | | |
| | | | | AAGGAAAAGGCTGAGGCTCTAGAGGAC | | | |
| | | | | CTGGTTGGCTTCAAAGAA | | | |
| 48 | 3312516 | 9 | MKI67 | CATGGGCAGATGTAGTAAAACTTGGTGC | 1.16E-08 | 0.076247204 | 0.00010532 |
| | | | | AAAACAAACACAAACTAAAGTCATAAA | | | |
| | | | | ACATGGTCCTCAAAGGTC | | | |
| 307 | 3312517 | 9 | MKI67 | AAGAGAGTGTCTATCAGCCGAAGTCAAC | 3.35E-06 | 0.022040564 | 1.75E-05 |
| | | | | ATGATATTTTACAGATGATATGTTCCAA | | | |
| | | | | AAGAAGAAGTGGTGCTTCGGAAGCAAAT | | | |
| 322 | 3312528 | 9 | MKI67 | TGTGACATCCGTATCCAGCTTCCTGTTGT | 0.000276123 | 0.011794395 | 7.23E-06 |
| | | | | GTCAAAACAACATT | | | |
| 1192 | 3316579 | 3 | RP13-870H17.3 | TGTGTGTGGACACTGCAACCCTCCCGAA | 4.46E-05 | 0.007081656 | 4.90E-06 |
| | | | | GCTGGGCCTGGAAGAAATGACTTCCCCA | | | |
| | | | | GAACCTTATCTGGGCCGGAGAGGGCGT | | | |
| | | | | TGGCAGCGGGGTCTTGCCGCCTTCCGG | | | |
| | | | | TCCTCTGCATGCCAGGCACCACCTGGGG | | | |
| | | | | CCGGGCCAGGGCAGGCTGCCTGGACACC | | | |
| | | | | ATGGACCTGCCCAGCTGTAGGGGAGGTG | | | |
| | | | | TGTCCTGCAGCCCTACCCGAGGCCCAGG | | | |
| | | | | CCTGCGTGGCTGAGAGGACTGAGGACGG | | | |
| | | | | CTGACCCCCTTGGTGACTGCCTGGGCCC | | | |
| | | | | AGAGGGGAGTTGGGGGAGTGGTCAGCT | | | |
| | | | | GGGTGTGGCCAGCCCTGGGGGAAGGATC | | | |
| | | | | CAGGGACTGTGTCCACTTAGGGATAGGA | | | |
| | | | | GGCAGCTAGCAGAGCCCTCCCAGCTGAC | | | |
| | | | | CAGGGGAGGCCCTGTGGGCACAGGAGG | | | |
| | | | | GGCCCCAGGTGTAGGTACAGGTGCAGGG | | | |
| | | | | CTGTGCGGCTCTGTGTCACCCAGGTGGA | | | |
| | | | | GCGTCTTGCCCCGTTTGATGGCTGACAA | | | |
| | | | | AGTGCCCTTGAATGCGTCAGACCCAGCG | | | |
| | | | | TGGTCCCAGGGTCCTGACCCTAACATAC | | | |
| | | | | CACCCAAATTACCCTCACCCCAGCCTA | | | |
| | | | | CCCCTGCCCTAAATTCACCCCAAGCCTCC | | | |
| | | | | ACCCAAACCCCTTAGTCCCAACACCTTA | | | |
| | | | | ACCCTAGACCCAACCCTACACCCCAAGC | | | |
| | | | | CCTAATCCCTAACCGCTAGCCTCACCCTA | | | |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ACCTTCCTACCGGATGCCACCTGGCAAA CATCCTCCTGGCCCCTATCTGCCCCTCCC CCGGGGATCCGGGAGGCAGTGGGGTCCC TGGGAGGCTGCTCCCTGCAGAACGCGAT GGACA | | | |
| 456 | 3317399 | 4 | KCNQ1 | GCTCTGGTTGGAAAGTGGCTAGGGTGAC CTCTGGGCCTACTGGCAGGGACGCCA | 0.006154763 | 0.010928167 | 7.03E-06 |
| 2082 | 3318045 | 2 | RRM1 | TTTGCTTGAGGTGGTAAGGCTTTGCTGG ACCCTGTTGCAGGCAAAAGGAGTAATTG ATTTAAAGTACTGTTAATGATGATAATG ATTTTTTTTTTAAACTCATATATTGGGAT TTTCACCAAAATAATGCTTTTGAAAAAA AGAAAAAAAAAACGGATATATTGAGAA TCAAAGTAGAAGTTTTAGGAATGCAAAA TAAGTCATCTTGCATACAGGGAGTGGTT AAGTAAGGTTTCATCACCCCTTTAGCACT GCTTTTCTGAAGACTTCAGTTTTGTTAAG GAGATTTAGTTTTACTGCTTTGACTGGTG GGTCTCTAGAAGCAAAACTGAGTGATAA CTCATGAGAAGTACTGATAGGACCTTTA TCTGGATATGGTCCTATAGGTTATTC | 0.0001169 | 0.00747355 | 4.30E-06 |
| 77 | 3319231 | 5 | CYB5R2 | TCTACAGCTGGAGGCGAAATCTCTCATG TTGTCCCTTAGAGGATCAAATGACTCCT AAGTCAGAATGGGTCTCGGGGCTCACTC TCTGGATGGAGCCCCTAGAAGCCTCTTA CCTGTGCCCCAGCAATCATTCCCAGGT GATCGGCCAGTGTTTTTTAGGCTCACTC GTCTGGTCTGGTCTGATTCCAAGATTCCC TGGAAACACAGAGAATGCTTATGACCTC TGCAGTTCTTGCCTAAAGAGACTGCAAA AGATCACTGACATTCCTTAGGACTCCCA GGAGGCACGTCCAGCTAAGGGACTGTCT GCACCATTTTAAGC | 0.007337714 | 0.028273098 | 4.44E-05 |
| 731 | 3320141 | 2 | ADM | AGAATCCGAGTGTTTGCCAGGCTTAAGG AGAGGAGAAACTGAGAAATGAATGCTG AGACCCCGGAGCAGGGGTCTGAGCCAC AGCCGTGCTCGCCCACAAACTGATTTCT CACGGCGTGTCACCCCACCAGGGCGCAA GCCTCACTATTACTTGAACTTTCCAAAAC CTAAAGAGGAAAAGTGCAATGCGTGTTG TACATACAGAGGTAACTATCAATATTTA AGTTTGTTGCTGTCAAGATTTTTTTTGTA ACTTCAAATATAGAGATATTTTGTACGT TATATATTGTATTAAGGGCATTTTAAAA GCAATTATATTGTCCTCCCTATTTTAAG ACGTGAATGTCTCAGCGAGGTGTAAAGT TGTTC | 0.000194662 | 0.007431738 | 2.85E-06 |
| 1849 | 3321317 | 2 | FAR1 | CTCATAAAACTTAGTGAACACACTGTGT TATGCCAGCTCAAATCTACAGTAGCCAC CAAAACCATGACTTAATATTTTGAGCCC TAGAAGAAGGGGTGTGCTGAGGACAA GAGTGGGGAAATAGGAACACTGACCAG TA | 0.00094743 | 0.00693472 | 6.58E-06 |
| 1231 | 3322467 | 4 | OTOG | TTCAGAAGACGGGTTGTGCCAGCAGTGA GAGGTCCAGGGTACCCAGGGGATTCCTA CCTGGACATCCCTGATGAAGTGGGGCCT G | 0.00877735 | 0.007993957 | 8.02E-06 |
| 343 | 3326990 | 4 | LDLRAD3 | GATAAATCATGTGCAAGTGTCATCGATA GACTAACAAGAG | 0.008566991 | 0.009998305 | 9.60E-06 |
| 346 | 3329359 | 9 | MDK | CAGGCCCGAGATGTGACCCACCAGTGCC TTCTGTCTGCTCGTTAGCTTTAATCAATC ATGCCCTGCCTTGTCCCTCTCACTCCCCA GCCCCACCCCTAAGTGCCCAAAGTGGGG AGGGACAAGGGATTCTGGGAAGCTTGAG CCTCCCCCAAAGCAATGTGAGTCCCAGA GCCCGCTTTTGTTCTTCCCCACAATTCCA TTACTAAGAAACA | 0.000111942 | 0.019795601 | 2.22E-05 |
| 1760 | 3329848 | 7 | CELF1 | TGGCTTGCTTGGCACCCAGGGACAGTAG CTGTTTGGCTCTCCACCCAAT | 0.005225318 | 0.007191149 | 5.91E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1309 | 3329913 | 2 | NDUFS3 | TGAAGTTAGCTGTTCCCTCAGTAGCTCTT TGTTCCC | 0.02450122 | 0.006617557 | 5.96E-06 |
| 236 | 3331846 | 3 | GLYATL1 | CCTCATCTCTGGGGATCTCAACCTCTC | 0.002099724 | NA | NA |
| 279 | 3331847 | 9 | GLYATL1 | TGTATCACATCAATCACGGGAACCCCTT | 0.003636318 | 0.013971736 | 1.16E-05 |
| 488 | 3331877 | 6 | | GATTGGGCATTTATGATATGGCAGGAAC TCCTTCTCACATGGAGACCTGATGTTAA AGGACACAGCCATGCTCTTGAGGAGCTT ACAATCCAAGCTGGAGGCAGGGGAGGG TATAGTCTTTAAATATGCTTAAGTGTTGT AGGGAAGGACAGAGTTACCAATAAACA TGTAACTAGAAAGCCAGGCTCAGTTCTT ACCTCTGGGAATCAGAACTCTTTATGAA ACTTGATTGATAGAATCTACTA | 0.040446406 | 0.011268756 | 7.13E-06 |
| 1593 | 3331913 | 2 | FAM111B | ATATGCCAATAATTCCTGGCAAAGATTT CATGACAAAGACACTTAAAGCAATTGCA ACAAAAGTGAAAATTGGCAAATGAGAC CTAATTAAATCTTCTGCACAGCAAAAGA AACTATCAACAGGGTAAACACACAACCT ACGGAATGGGAGAAAATATTTGCAAACT ATGCATACAGCAAAGATCTAATATTCAG AATCCATTAGGAACTTAAACAGATTAAC AAGCAAAAAAAACAAGCAACCCCATTA AAAAGTGGGCAAAGGACATGAACAAAC ACTTTTCAAAAGAAGATATACACATGGC CAACAAGGATATGAAAAAATACCTGATA TCACTAATCATTAGAGAAATGCAAATCA AAAAAATGCCATCACACTAATCAGAATG GCTGTTATTAAAATGCCAAAAAATTACA GATGCTGGCGAGGTTGCAGAGAAAGGG GAATGCTTATACACTGCTAGTGGGAAAA TAAATTAGTTCAGCCATTGTGGAAAGCA GTTGGGTGATTTCTAAAAGAACTTAAAA CAGCTACCATTCAAGCCAGCAATCTCAT GACTGGGTATATGTCCAAAGGAATATAA ATTGTTCTACCATAAAGACATGCACATA TATGTTCACTGCAGCACTATTCACAATA GCAAAACATGAAATCAACCTAAATGCCC ATCAATGGTAGACTGGATAAAGAAAATG TGACACATATACACCATAGCATACTACA CAGCCATAAAAAAGTACAAGATCATGTG CTTTGCAGCAACATGGATGGAACTGAAG GTCATTATCCTAAGCGAACTAATGCAGG AACAGAAAGCCAAGTACCACATGTTCTC TCATAAGTGGAAGCTAAATATTGAGTAC ACATGGACACAAAGAAGAAAACAACAG ATATGGGGCCTACTTGAGGGTGGAGGGT GGGAGGAGGGTGAAGACTGAAAAACTG CCTATGGGGTACTATGCTTATTACCTGGG TGATGAAATAATCTGAACACAAAACCCT GGTGACATGCAGTTTACCTATATAACAA AACTGCACATGGACTCTTAAAC | 1.74E-05 | 0.009308618 | 5.06E-06 |
| 1489 | 3332111 | 3 | AP000442.1 | CAGGGTCTGAACTCTGTAGGTCTTCACC ACGGCTCAGGAGGATGAGGAGCAGTGA CAGGCCAAACTACGAGAAAAGACAGAG GGAATCAAACTCAACACTGTGTCTAAAC CTCCTCCACCACTGTTGAAGGGATCCTG GCATCAGATGGGAACAGCTCTAAATCA AAATAACCTCACTACTGTGCTTTTCTGTA AAACCAGGTAAAGATCAGACAAGCATG AGTTGAAAGGCTATGTCTCTCTCCAGGC TTTATTCTGCCATAGCAGTGACCAGGCG CAGCCAACAGAAACGGAAAGTCATGGT GTCCAACACGCCTCTCTGTT | 0.011353565 | 0.006946152 | 3.91E-06 |
| 168 | 3332705 | 2 | CD6 | GAGCCCTCTGTCTCGGGGATGAACAAGC AGAGTCTGGGCTACCTCTTGACAGCTGG TGGAGGGGAGTTGGGGAGCTGGACTGG ATGACTCTGGAGGCCCCTTCCAAACCTC AAGTGTCCGGCGCTTTGATTGCCTGAGTT TCTGACACTTCAGGGCCCAGAGGTCCTG CGAGGGGCAGAACTGGACCCCCATGCCA | 6.62E-06 | 0.024221205 | 2.00E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GTGCTGCTGCAGGAGGGCCCATATACTA GGGTCTGCTGAGCTGTTGTCACTGATCG GTGGGCGCTGGGGGGGTAGGGTAGCAC ACCAGCTGTCCCAGGCTTTGCTCCGGGC GGTAACTGCACTTGGGCAGGGAATATAG CCTTCCTGGGCACAACTAGCTGACAATG ACAGGTTGACTGTGTACCCCCAACCAAG GAGCTGGGGCCCAAGGCCAGTCCTGCCC CAGAGACACTCCAAGTCCGCCAGGGGCA CAGACCAGTTCTGCAGTGACTGTCCCTG GACAATGGGTCTTTATTCTGAGTTTCCTA TGGTTTACAAAGAGGGCCCCAGCCCAGC CCCACCACAGATCCCAGAGATAGGGGCC CAGTCTCCATGGGGCAAGGAGCATAGA GATGTTTTCCAGGAAGGGGCTCAGAAGC TGCACTAGGCCCCGAGTCCCCATGTGTC TCCTTGAATTGATGAGGATGCTCCTGGG AGGGATGCGTGACTATGTGGTGTTGCAC CCGGGGCTGCAAACGTCTCCGTGCAGCC CCCAGAGAGAGGCCCATGGGCTCAGACC AGGCTTTGTTGTCCTGCTCTGAGTATCCT GAGATTA | | | |
| 654 | 3332877 | 4 | DAK; RP11- 286N22.3 | GACGGTCAATATTAGCCCTTCTGCCAAC ATCTGGCAATGTGAGGCTGGGGTGGACG TTGGCCTGATGTTGCCAGGAGTAGGATG CTGATGCTGCCAGAGAGTAGGTGGGCTC CAAACCCCAGGCTTCTCACTTGCTTACTA AGCACAGCAGTCTGAAGCTTGGGACCTG GCAGTGCGTCTTTGGAGAAGGCAAAAAA GCCACAGCAGCAACACTTAGGAGCAAG ACCCTTCCCGCTCTCCACCCTATTTCCTC CCCTGAAGAAGAGCAACAGCTCAAGCTC TAGCATGGCACAGAACGCTAGGTTGGGC CAGGCAAGCAGCCATGGTGGGGCCAGGT GAAGCAATGTGGGTCTCAGCAAGGAACC CCTCTGAAGGTGGCAGTGGCTCCCAGGG CTGCTGCACACTGGACACCACAACTTTG GCATCAGCTGCATGGTGAGCTGCAGAGT GGTCAGAGGGCTGGGGCCCTGCCAAGA GAGCAAGGCCAGACCTGCCCAGCGGGA GGCAGGAAGGCCCTGATCCAGCAAGGA GAAGTAGAGGAAGTCCACAGCCACCTCT GTTACTCATCGCTACTGGGA | 4.74E-05 | 0.008544328 | 3.23E-06 |
| 2009 | 3333236 | 6 | | TGTTTGTGACTGATTACTGGCTGTGTCTT GGGTGGGCAGAAACTCGAACTTGCTATG TAATTTGTGTCTA | 0.000457168 | 0.009182253 | 5.87E-06 |
| 632 | 3333240 | 7 | FADS1 | CATGGGTGGTGCATCTGACCCTATCCCA ACATGCCTTAGGACGCTCATCTCCTTGAC TGTCTGCCATCCCCTCCCAAACTAAGT GGAGGCTCTGTCTTTTCCTCCTAGTTTGA GGTTCTCTTCTCCCAGTGTCTAAAATGAT CAATATGCCTAGAGTAGATGCTGCTGAA GAGGCAAAGTAGTAATCCTGCCACCTGG AAGCAAAGGCTGTGGGTTGGAGGGGGA AGCGGGTGTGAGGGCTGATGATAAGCCC TAGGAGGCTCCTGAGTCATATTCC | 9.43E-05 | 0.014572418 | 1.23E-05 |
| 1972 | 3333487 | 2 | ASRGL1 | GGACCCTCTGGGAATCCATAGCTTCCTA ATCTGGAGATGGGAGGTCATAAGGGAG ACGCTGTGGGGTTCCTTGAAGTTTCTTGG GTTCACAGAGGAGCCCCCTCACTTGGTG TTCTCCCGTGAGCCAGCCTCCACCTGCCA AAGACACTCTGGTCCTCGTATAGTGAGT AATGGGGCTCAGGGCCTCTCCAACAACA GAGAGGAGCTGATGCTGTAGGGCTGACC CCGTGACTTCCTGAGTCCTCACCCTGTCC AGTGCTTTGAGATTCTTCCCACCTCCCCA TCCTCACCAGCCGGATCGGGCGCTGTGC AGTGTGGTCAGCATGGTGAAGAAAGTCA TTTCCTCGGTGGGCAGTATTCCTCTTTAT CTCTCATTACACTGGAAATGTTATTTCTG | 0.001265835 | 0.006689375 | 4.50E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 187 | 3333728 | 2 | SLC3A2 | CTGTATCATCCGTGCTCAACGTTTTAGTCTGTCAGGCTCAACATGTTGACCGGTCTGGTTTTGAACTCGCCTGCCTGCCTTCCCATATCTTAAGGCCCTTCCTTGCTCACATCTGTTTCAATGGAATGA | 3.46E-05 | 0.02137965 | 1.84E-05 |
| 1679 | 3334217 | 5 | MACROD1 | GAGCCAGGAACCTCATAAGGACCTAGAAATGCCCACCACCATCCTAATCTGTAAAATGGATCAGCCCCTTCAGGCCTAGAGGGGTGGGGTAGGGGGCTGGGCTAGGCAGGAAGAGGGGACTTAGAGGGTGTCACTGATTCGTGCAGCCCCTCCCACCATCTGACCAACTCTCAAGGGCATGGAGTCACTTATTCATTCAACAAACATCAGGTCAGACATGG | 0.000438052 | 0.007910565 | 3.13E-06 |
| 1889 | 3334931 | 2 | MRPL49 | GGGGTCAGGCCTTGCTTGCATAAAGGAGAAAACAACTCTATGTACATGCTGGGG | 9.46E-05 | 0.00816066 | 3.93E-06 |
| 1744 | 3335187 | 3 | MALAT1 | ATTCTTACATGCAGGAACACTCAGCAGACACACGTATGCGAAGGGCCAGAGAAGCCAGACCCAGTAAGAAAAAATAGCCTATTTACTTTAAATAAACCAAACATTCCATTTTAAATGTGGGGATTGGGAACCACTAGTTCTTTCAGATGGTATTCTTCAGACTATAGAAGGAGCTTCCAGTTGAATTCACCAGTGGA | 2.12E-05 | 0.006711132 | 4.85E-06 |
| 2032 | 3335239 | 3 | NEAT1 | CCGATCTGCCATATCCTGTGTAATGACAAGTGAGTTGCATTCTCACCGTCACTCCTGGGGTCTCTCCGCTTCCCTGAGCTGGCTCAGCAGTCTGCTCCATGTGTTTTGATGCAGGGTGACCCATTGGTATTCCCGACACTA | 0.000296032 | 0.007557915 | 4.73E-06 |
| 1640 | 3335344 | 4 | SSSCA1; FAM89B | CAAATGTTTTGCTGACGTTACTTCATTTCATCCGGCTAAATGGATAACCCCATTTTTTGGGTGAGGGTCATGACTAAAGTTGCATAGCTTGCAGGTGG | 4.05E-05 | 0.007034036 | 6.22E-06 |
| 283 | 3335444 | 9 | PCNXL3 | TGGGACTTGCTGTACAAGCTGCGTTTCGTGCTGACCTACATCGCGCCCTGGCAGATCACCTGGGGCTCGGCTTTCCACGCTTTTGCC | 0.009647164 | 0.012006177 | 6.85E-06 |
| 2035 | 3335570 | 1 | | CTGTCTGCTCCCCTATTGGCGGGTGGTGCTGGCTCTGTCCCTGGCAAGGCCAGGCATGGAGCTGAGCTCAGACTGTCACCGGACTCACCCGGGACAGCAACATCCCAGTCGAGGGCCCAG | 7.50E-05 | 0.006753736 | 2.46E-06 |
| 2078 | 3335635 | 6 | | AGGTCCCTTACTGGTCCTGCTTCCATGAGTAGCCGTGACCAGGGGAAAAGGGAGAGGAACCAGCCGGCACAGGGAGGGGTCATCTCCACAACATTCCATTTATACACAGAACTAAACAGACAAGCACAGAGTCACTATTGCGGTTAGAAGTTGGCAGCATGGGAAGGGGGAGGACCAGGTGGGGAATGGGGATGTTGTTAAAAAAAATACAGGCTCCCCCACAACTGGGGTGCCTGGGGGGAACTTGGTCTGCTTCAGCCCAAGAGGAATCAAAAGATCAAAAGCAGTTTGGGAAGGCCAGAACCGTCAAGGGATGGAGGGAGAAGGAAAATCCAGGGGGTGGGGGTCTGTTTGGCAACTGGGGTGAAGGGATTGCCCTCCCCCTGCTGGGATCCCCCCAGCCCCTCCGGTCTGGCAGGAAGGGGGCAGCCTGCAACCCCCAAGGGCAGGTGTGGGGCTGCCAGATGCTCCAGGCAGGGGCCAGAAGGGGCTCACAAAGGCTTGC | 5.37E-05 | 0.007183286 | 6.76E-06 |
| 1624 | 3335777 | 9 | SART1 | CGCGTGAAGCGGGAGAAGCGCGATGACGGCTACGAGGCC | 0.000133772 | 0.007144549 | 4.34E-06 |
| 1764 | 3336464 | 5 | RBM4B | AGCTGCATGGTGGTCTCAAGAGATCTCAAGTCTTGCTGACATGCATATAGGGTACAACTTATTACAGGTTCATAACATTTGCTTCTCAATTCACATAAAAGAGCAAATTGCTGTGGCTTTGCTTTTTAATTTTTTTTTTTTTTAAGAGAGAGGAGCCACTCTTGCCCAGGCTGGAGTGCAGTGGCTAACTGCAGTCTCTCACTCCTGGGCTCAAGGGATCCTC | 0.00271316 | 0.009071279 | 8.82E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CAGCCTCAGCTTCCTGAATAGTTGGGAC TACAGGCACAAGCCACTGTACACAGCTG CTTTGTTATCTTCTACATATATACCAAAG GGATAAGTTAGGAACACCAGAAACTCAG TAGTAACTCACTTTAACCTTGCTTCTGGG GCTCCAATTCAAGTGATGCTCAATTTCA AGGTACAAGGAAAACCATGAGAATATA AAGTCATAATGCCATTTCCACTCAGATG AAAAGATTTATCTATCTTTAGATACTCAA AATTATTCTTGGCATTTTAGCACTTTTGG TACACATTTCCTGATGTAGGAAATAGTA AAATTTCAGAGCCTATGGCATTGGCTTTC ACCACCTATGCAATTTTCTACACATCTGA AAATTACCAGTTTATCTAACTCCTTAAAT GTTCCTCTCTTCAACAACAAAAAACACA AACAAAAATTGCTGGAAGAAACAGGAA GCATCCAGGTCCAAATGACAGCATAACA GACTATGAAGAAACAGGGCTTAAGTGCC CATCTAGAACAAGATGGTCTAGATTACA ATAAGGACCCCATGGGACAGAACATCAA AACATTCAACTTTCAAGTAAATGTCTTG GAAGTAAACATTTAAAATTTATAGGACT TCCTCTGGCATGTAGGTA | | | |
| 669 | 3336491 | 4 | C11orf80 | TTCTGGGTTCGAAGCAGCTGGACGTGGA AGGGCGAGGTTCAGAGGCCACACCTGTG CTCGGGGAGCTGCTCTGGAAGACGGCAC TGAGCGCCTGGCGCCGGCCACGCCCCGT GTGCTCATTTCATTACCCACTTTCACGGC CGGTGCCCAATGGGACGTTGAGCTGCTG TTT | 0.000122396 | 0.008642129 | 3.62E-06 |
| 183 | 3336510 | 4 | C11orf80 | GATTTCATCATGGATGCCTCAATTGAGG AGAAA | 2.67E-05 | 0.021906893 | 2.50E-05 |
| 248 | 3336517 | 4 | C11orf80 | TGATTTCTGATAATTTGTGACAACCTGGA GCTGTGATATAGGGCTCAATATATTTAA GATTTAGAATTTAAACACAGGCAAGCAT TAAGTATGTTTA | 0.000611594 | 0.017681213 | 2.55E-05 |
| 473 | 3336722 | 4 | KDM2A | CCTTGGCAAACTGACAAGGATGTCATAT ATGTATTGTAGTGGTCAAAATTAATGTTT TGTTTACTTTTTTTTTTGGAGACGGAGTC TTGCTGTGTCACCCAGGGTGGAGTGCAG TGGTGCGATCTCGGCTCACTGCAACCTC CGTCTCCTAGGTTGAAGCAATTCTCCTAC CTCAGCCTCCTGAGTAGCTGGGATTACA GGCACGTGCCACCACACCCGGCTAATTT TTTTTTTTTTTATACTTTTAGTAGAGACG GGGTTTCGCCATGTTGGCCAGGCTGGTC TCGAACTCCTGACCTGAGGTGATCTGCC CACCTTGGCCTCCCAAAGTGCTGGGATT ACAGGTATGAGCCACCACACCTGGCCCT TTTTTTTTTTTTTTAACTCTTCAGAGACA GGGTGATGATAATTTCTGTTTAGCATTTA TAAGATGACTCACTATTAGTAGTCCTATC CCCATATTATTTAAGCTCTAAATTTCCTG TGGAAATTTAGACTTGGAATATAGACTT GGAAAACCCCTCAAGCGTTGCTTCTCAA TGTGCTC | 6.62E-06 | 0.015914087 | 1.54E-05 |
| 1202 | 3336851 | 2 | ADRBK1 | GCAGGTTGGGCCATACTGGCCTCGCCTG GCCTGAGGTCTCGCTGATGCTG | 0.005203274 | 0.007814406 | 2.76E-06 |
| 1009 | 3337064 | 9 | CARNS1 | TGCTCGATGGAGTCTTCAACGTGGAGCT CAAGCTGACCGGGGCTGGGCCTCGGCTT ATCGAGATCAACCCCCGCATGGGTGGCT TCTACCTGCGTGATTGGATCCTGGAGCTC TATGGTGTTGACCTGCTGCTGGCTGCTGT TATGGTGGCCTGTGGCTTGCGTCCTGCCC TGCCCACCCGCCCACGTGCTCGTGGCCA TCTGGTGGGCGTCATGTGCCTTGTGTCCC AGCACCTGCAGGCCCTGAGTTCCACCGC CAGCCGTGAGACCCTGCAGGCCCTGCAC GACCGTGGACTGCTACGCCTCAATCTGC TGGA | 0.005348101 | 0.00726324 | 2.93E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1226 | 3338508 | 9 | PPFIA1 | CTGGTGTTTCCGAGACGGATAACTCATC TCAGGATGCCTTGGGACTTAGCAAATTG GGGGGACAGGCT | 0.043299568 | 0.006560039 | 7.24E-06 |
| 873 | 3339046 | 6 | | GAGGCAATTTTACACCCATCCGACGCCT CACATTTGAAAACCCAATGGCGGTACTG ACAGGCCTGGGGCAGCGGACGCTCTCAG GCATTGCTGAGGAGAAGGGAAAGCAGC TTGAGCGTTTGGAAAGCTGTCTGTTTCTT AGAAAGTTAAGCATACACTACTCTATGG TCTAGCAAGGCCAGTCCTCAATATTTAA CCAAAAAATTAAAACCAAAAACATGAAT ACGGAAGGACTGGAAGGCATGATTATGT GTTATTTATCATCGCCCCAAACTGCGAA CAATTCAAATATCTATGAACAGGAGAAT GGAGGAACGCCGTGGAGAGTATTTTTAC A | 0.003098917 | 0.007737485 | 4.79E-06 |
| 815 | 3339248 | 9 | RNF121 | CAAACCAGAAGATGCCATGGACTTTGGC ATCTCCCTTCTCTTCTATGGCCTCTACTA TGGAGTTCTGGAACGGGACTTTGCAGAA ATGTGTGCAGACTACATGGCATCTACCA TA | 0.000337386 | 0.006535423 | 3.33E-06 |
| 1599 | 3339697 | 5 | FCHSD2 | AAGGCAATGGAGAGTTTGGCTCCTGCAA AGTAAAGGAAACTAAAAGGGCTCACAG TGGGACAGGGATCAGGAGCCAGGTTCAT AGCTTGAAACCAGGCACTATAGTGAGAT TCCCGTGTTCATGAAGGA | 0.000228432 | 0.006761278 | 4.54E-06 |
| 794 | 3339872 | 2 | ARHGEF17 | CACACATGTGCCTGCGTGGGCTCTGCCTT GTCTTCGCGGAAGCATTCCTGATGGAAC ACCCACTGGCCAGCCAGGCCATGGCTTC TCCCGACCCTCT | 0.034740252 | 0.006686228 | 3.12E-06 |
| 92 | 3340087 | 4 | PAAF1 | GGAGTCATTTATGCAGCTCCATCTTCTCT GCCCTTGTAGTTCCTTTACTCCATCCTCC ATCTTAGGGAGTTTTT | 2.10E-06 | 0.030966825 | 3.44E-05 |
| 1268 | 3340183 | 9 | PPME1 | GTAGAGTTCAGTGTAGGATTGTAGCTTT GGATCTGCGAAGTCATG | 0.002514771 | 0.007854617 | 3.58E-06 |
| 111 | 3340387 | 4 | SPCS2 | TCAGCTTCTGAGTTTGCCATCAGTTTTTA TTATCTCCTTATTTTAGTTTAGAACTCCA CATATACAAATGGGTATTTATCCTTTTTC CTCCTGTATTCTTCTTCTTGGAAAATGAC ATGATGGCTCCAACAAGTCATCCAAGCC CTAATTCTAGTAGGTGGTCATCTCTGTCT CTTCTCTTTCATGTTCCTTATAACTAGTC TGTTACTAAGTCCTGCCAATTCTACCTCA GAATACTCCCTTTCAGTCCCCCTACTGCT GCTCTGTTGAGCATTGAGGCTCTGCACTT ACATCAGGCCCCATCTGCATCTCTATGTC CAGTGTTACTC | 6.42E-05 | 0.027924152 | 2.54E-05 |
| 758 | 3340768 | 4 | UVRAG | TCAAAGAAGACGACATTCCCAGATAGAA AAGGAAGCAAACGTTTTTTGAGAATGGA GACAAAAACTATTTTGCACATCATAATT TTTCCATTAGCAAGCACAATGCCAGAA | 0.006855816 | 0.012411782 | 9.19E-06 |
| 1787 | 3340811 | 4 | UVRAG | CATTTATTTATGATCAACCAGAGAGACT AAACAGTGGACTCATGGGTTTGGACTCT ATTGCAATTCAA | 7.63E-05 | 0.008875995 | 5.36E-06 |
| 1574 | 3341181 | 9 | CAPN5 | TGCCGGTACTTCACGGACATCATCAAGT GCCGCGTGATCAACACATCCCACCTGAG CATCCACAAGACGTGGGA | 0.000496534 | 0.009800362 | 6.74E-06 |
| 1294 | 3341189 | 2 | CAPN5 | GTCACCACTGCTAAGGGACTCTATCCAT TGAGCACATTTTCCTAAGGCCCTGCTGTC TGCCGAGGAGCGCCAAGAAGATGTCACT TGTTTACACACGAACTGCCACATCCCCA AGCTCCGTTCTTGCCCCTCGTGTCCTAGG CCCAACCCAGCCTCCAGACCTCACTTTC CCCATCAGCAATACCTGGTGTTCTCCCAC CTTGAAAGGACTCTTGGCTCCTGCTGGGG TTCCTGCTCAGGCTGGAATTGGGAAAAT ATGCAGGTGACATTTGTTCATTCTCTAAT CCCATCCTCTCACCCATCCATTTCCTCAC TCAGTGGAGATTTGCCAAATGAATAAAC GACACCTTTGAGGCCCCAGGTGAAGCGG | 0.009436864 | 0.015307962 | 1.31E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GGCCCTACTCCGGCCTCTGCCTTGGGCCT CGCCTCTGTCCTCAGGTCCTCTCAGAGGC AGATACCTAGGGGAGCTGCTGCTGCCTG CTCATTCTAGCTTCCGA | | | |
| 1857 | 3341212 | 4 | CAPN5 | CCCACTTGGGTCCTTGGCGTTGGTGGCA GCA | 2.80E-05 | 0.006838246 | 3.07E-06 |
| 617 | 3345158 | 4 | PIWIL4 | TGCAGCTCACACAGAAGGGACTACTGCA AAGGACCCAGGTCTACCCTGGCCATTGA CATTAGAGGGCCAGGGATCCTCCCTCAC CCCACCTTCTGCACGCTTCTGTAGGG | 0.006687861 | 0.010150886 | 6.44E-06 |
| 2013 | 3345244 | 9 | AMOTL1 | CCCAACCGAGAACATGAACTTGCTGGCC ATTCAGCACCAGGCCACAGGGAGTGCAG GACCAGCCCATCCTACAAACAACTTTTC TTCCACGGAAAACCTCACTCAAGAAGAC CCACAAATGGTCTACCAGTCAGCACGCC AAG | 0.001689593 | 0.006558789 | 5.28E-06 |
| 1534 | 3345406 | 3 | SRSF8 | TGGGTCCTCCACTAGCTCTCGCTCTGCAT CAACCTCCAAATCGAGCTCTGCGCGACG ATCCAAGTCCTCCTCGGTCTCCAGGTCTC GCTCGCGGTCCAGGTCTTCA | 0.010080553 | 0.006911306 | 3.45E-06 |
| 82 | 3345480 | 4 | RP11-712B9.2 | GATCCATTTAGGTCAGCTTTAGTCAGAA CTGTAAAATCAGCAAACATAAGAAAAAC AAAACCTAGTAATACATACAAAAGCTTT CATGGGTTCTAGAACCTTCTTAACTGCTG ATTCATGTGGAGGGCATTAAGAGTTGAA AAGGCTTATATGGTTAACTACCTTAGAC TATATCTACAGCAGGGTCTGGTTTGCCA GAACAAGTTTAAAGTGGCTGTTTATTAA GTTTGCTATTTTCAGAATTGAAACTATAA GACCGCCATTTGACACTGAAACTTGCGT GAATCCTAAATTGCATCAATTATCTATTT GATAAAAGCTTATTCTAATTTAAAACCTT ATAGAGTAAGAGACTGATATATATAGCA GTCTTAAAGATCACGTCATCTGCCTTACA TTAGTCCAGTCACGTGCTTCGTA | 1.81E-08 | 0.037576248 | 4.27E-05 |
| 1964 | 3345483 | 4 | RP11-712B9.2 | TCAGTCTTGTGTGGGTACAGGTTTATATG TGCCAACTAAATGAACTGTAAGCAGCAC TGTGAGCACTGATTATTTAAGGTGACTG AGGATTACTGTCAGTGATAGGATTGTGT TATAATTCCACTTATATACATCTGATATG GAAAACTGAAACTTCCATTTTAGAAGAG AAAGAAAATAGCTGAATTTGGCATTTCA GTAGCATGCTATAGAATTCATCATGATT AATTTCACATTAAATTATGGGCAATAGC TGTATCACATTTCA | 1.05E-05 | 0.010257851 | 4.80E-06 |
| 959 | 3345752 | 5 | MAML2 | GCTGACTCATGTACCTCACCATGCAGAT GAGGGTGTGTTATAACCCACAGTGTGTC TGTGTCCCTGGATGAACTGAGCACTTTAT A | 0.001302035 | 0.007036077 | 1.13E-06 |
| 1290 | 3346491 | 4 | YAP1 | CTGCCTACTGTGTCGTCTTTTCTTATGTT GAAGTTGACAGACCTGCTCTATTCTCAT ACTAATAGACTATTTTTAGATTTTTTTAA AGTAATCACAATAAATTCAGTATATCTT AAGTCTTTTGGCTTCCTGTGAACTTCTTC CCTTGACAGTTTATCTTAGCACTGAAAC ATCAAATATATTGTATCTGCTTTATCTAA TACTCAGAAACAAAGAACCTACGTGACC AATATCAAATTTTATTTTTTAGTTCTGAC TCCTAAAGTCTTGCTGTCCTATCCTCAAT GCTGTTAAAAACTTCTGAGGTTCCAGTTT TGTTATGTGGTGACTCCATTGGCTCCTGT CTTCGTCAGTCTGCTTCTTCTTGGGTA | 0.000368854 | 0.008650836 | 4.28E-06 |
| 401 | 3348854 | 2 | DLAT | TTTGCAACCAGTACAGCCTGCGCGGGGC GCGGCCCAGTCCATCCCCCTTCGGATGC GCAGAAGCAGAGGTCACCACGCCGGAC CCCTCGATTCCCTCGCGGGCGATTCCTGG CTCCTTCACCACCCCAGCACTCCAAGAC CCCCGCCCTTTGGCCTGAGGCTCCCACTG CCCTAGCCAGTTCCCGGGCTCACTTCCA GCTTTTCCAGAAAGCTTGGCCACGCCC | 0.025452776 | 0.011991906 | 1.01E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 349 | 3349774 | 4 | ZBTB16 | CCTTTTGGGGATCTGGCATTGAAGCATCT GTTGATCCACTGTCTCTTCGCCACTCCTT GTCGTAACACGAGAAGTGATTCCTA | 0.017855277 | 0.010864318 | 6.21E-06 |
| 1915 | 3350647 | 6 | | CAACCTTAGAGGATAGAGCATTATGTGG AAGGAGGGTGAGGACTTGATATGAAAA AAGTGATGACATACCCCTGGTTCATTTCT GGGTTTCCTCCTAGGCCAATTCAAAACTT CCAAAATAAGGTCAAGTAACACAATAGG CTCACACTTGCATCACAAGCTG | 0.00028925 | 0.007811622 | 4.02E-06 |
| 1210 | 3350849 | 6 | | ATGGGCACACTCTTGGCATCAACTCTCTT GGTCCAATGGCAACCCTATATATTGCAC ACGGGACACTTTCTGTGGGGACTCTGAG ATGCAGAGGGACCAGATAACAAGCAGG AAAGGTAGGGCCTGGTGTGAGGGCACG AGACTCACCGACATCCCTGATGACAAGC CTGTAGGTCCCTCGGGCTCTCTCCCCCA GCATCGCACAGTGGAGAAGGTCCAGTCA TTGAAGCCGTTGGGATCCCTGAGGAAAG AACACAGCAGAAACAGGTGGAAGGCGT GGGCCAGAGAGCTGACCTTCCCCCAGCA ACACTTTCTTACTGTAGTAGCCGTGGAA ACAACCTGGGAGGGTGCCACGAGGGCTT CTCAGGTGCCCCTTTCCCCTGGGGTCTCA TGGAAGGAGGAAATTGTGTTAACGTGGT GTGGTGGAAAAAGCAAGCATGGAGCGC GCACAGGCTTGGAGTCCCACGGATCTAG GTTTATTCTTGTTCTCTTGGGCACTTACT AGCTCCATGACTTGTTTTCTTTTTCTTTCT TTTTTTTTTTGGAGACAGGGTCTCACTCT GTTATCCAAGCTGGAGTGCAGTGGCATG ATCACAGCTCACTGCAGCCTTGACTTCCT GGGTTCAAGTGATCCTCCCACCTCAGTCT CCTGAGTAGCTGGGACTACAGGCATGTA CCACCATGCTCAGCTAATCTTTAAATTTT TTGTAGAGACAGGGTCTCACTTTGTTGCC CAGGCTGGTCTTGAACTCCTGAGTTCAA GTGATTCTCCTGCCTTGACCTCCCAAAGT GCTGGGATTACAGGTGTGAGCCACCACA CCCAGCCAGTTTCCTCATTTGTAAAAGG AGGTTACAAAGTCTAATCTAGGGGGTTC TTAGAAGGATTAGAGAACATGTATGTGA GGTGCAGGGCCTAGCGCTTGAAGAAGGT ATGTGACGAAAGGCTTCCAGCCGCCAGG GATAGCCAGTGCCACAGTAGTTTAGGAC AGTGCCAGGATCCACTTCTTCCATTTCTT TTCCCTGGAAAGGCCCTTGCTGAAAAGG TTGCTCAGGCCTCGGCGGGTGTACATA CGAGTCCATGCTGCGGGGGGCGCCGATG AGGGACATCATGCCACTGGGGCAGAACA GCTTCAGCTCCAAGCTGCCGCGCCGTGG GTGAGTGATGGAGACTGTCACTGCCACA TGCTCCAGGGTCTTCAGCCCTGACATCTC CAGGTCCATCCTGCTGACTGTAGAAAGT CAGGCTGGGCAGCTGGGAAACCAGCCCA CAAACACGCCTTCACTTCACCCCCACGT ACACAAAGACACACGCTCACTGAAGCCA CATACAAACATCTACGGCAACCCTAACT GGGACCTCGCCTATACTAGTAAATGGAA TGGAGCTGCTGCTCTCAAGTTTACAACG TAGCTTCGAGTGCAGTTGGGAAGACGAC ACATACCCAAGCACAATATAAGAATCC AGCAGAGCAACTTCAATCATTCATTCAT CCAAAACATTATTTACTGGGTACCTCCTC CATTTCAGGCACTGTACTAGATGCTGGG AATATAAAGATAAGATGGGCGTGGTCCC TGCCTCCTACCTGCAAGTGGAAAATGAT ATGGTATGGGAAATATACATAATTGATA AGGGAAGAGAAATAAGTCAGATGGGTTT AGGCACACAGCAGTGAGACACACTGAA GGAAATGAATACAGATCGGTAGACAGG | 0.038283273 | 0.007497037 | 3.10E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
|  |  |  |  | GTTGGTAGAGGGCATTCTAGGCAGTGGA AAAGGCATGAACAAAGACGAAATGCAC ACATCTCACTGAAGATGATGCACAGTTA ATTTTTAAAAAATGCTGGTGGATAAATT TCAAGCAAATTATGTGAGTGAAAAAAGC AATCTCAAAAGAAGCATATAGCCAGGTG TGGTGGTGTGCACCTGTGGTCCCACTAC CGGGGAGGGTGAGGTGGGAGGATCGCTT GAGCCTGGGAGGTGGAGATTGCAGTGAG CCATGCTCATGCTACCACACTCCAGCCT GGGCAACAGAACAAGACCCTGTCTCAAA GAAAAAAAAAAAAGAAAAAGGATGCG TAGCACACAATTCCATTAGGTGATGTT AATTGAAGTACCTGCAGTGATACATAAC AGATAAATGGGTGCCAGGGGCCAGGGA CAGGGGAGGGATGGGTGTGGCCAGAA AGGGGTAACACAAAGGAGTCTTGTGATA ATGGAATTGTTCTGGATCTTGGTTGTGGT GGTAGTTATGCAAGGCTACATGTGATAC AATTGCATACAGCTACACACGCGCATAC ACAAATATTGACAGCATGTGTATCTGGT GAACTCCAAATAAGCTCTATGGATTGTA CCAATGTCAATTTCTTGGTTTTGATATTA TACTTTAATTGTGTGAAACATTAAGATTG GGAGAAGGGTGCACGGGACTTCTCTTGT ACATTTC |  |  |  |
| 1024 | 3351637 | 4 | UBE4A | CACGAGAGTCAGCTGTTGGAGAATTTTG AAATCATTGACAAGCTTGTGTGTTCATTA AGATTCTTCTCTTTTTAGGGTTTCTCCCC TTCTCTTCTTTCTTTTCCTTCCTTGTCCCC TTTCCCCAGAAAACATTTTTTAAAAACC AGCAGTTAGTGCAACTAATGTTCAGTCA GCACACAGTG | 0.0001886 | 0.013100313 | 9.63E-06 |
| 1511 | 3351903 | 3 | C2CD2L | GCAGGGGCGGTTCCATTGGCTCAGCTTC TTCCATTTGTTTCCTCTCTGGGATGGAAT TCAGGAAGGGAGAGTCCTGAATTAGGA GTCCTTGGGTAAATGGGGCAAGTCAGCC CAGTCACTTT | 0.000138152 | 0.006533071 | 1.21E-06 |
| 83 | 3352135 | 7 | MFRP; AP003396.1; C1QTNF5 | GGGGACTTACACTTGCCAGCACAGCACA CTCCTCTGGTCTTGGGCAGAAATCCAGC CACTGCCCCATGCTGCCAGACCTGATCG CAGACAGCCACTGTTCCCATTCCTTG | 1.97E-07 | 0.031497369 | 3.10E-05 |
| 992 | 3352315 | 1 |  | GCCTCGGGCTGCAGACTCTGCTGGTGGA TTCAGCGATGAGGCCCTCAGA | 0.000142286 | 0.008881946 | 2.42E-06 |
| 1718 | 3354757 | 6 |  | AACATCACCGTGAGTCTGAAAGGACCAC AGGTTTTTCTGCAGCTATTTTCTAGCATT TGCCAGTCCCTGTGCCTGGACTGATTGG AACACTTTGTTTTTCTCCCTGTGCCATTT ACCCTTCCACCTTTCCATCCTGCCTTCTA CCACCCTTGGATGAATGGATTTTGTAATT CTAGCTGTTGTATTTTGTGAATTTGTTAA TTTTGTTGTTTTTCTGTGAAACACATACA TTGGATATGGGAGGTAAAGGAGTGTCCC AGTTGCTCCTGGTCACTCCCTTTATAGCC ATTACTGTCTTGTTTCTTGTAACTCAGGT TAGGTTTTGGTCTCTCTTGC | 0.00050277 | 0.011369051 | 1.04E-05 |
| 482 | 3355746 | 4 | FLI1 | CATGCTCCTCCTATCTGGGCTGCAATCAG CAGTGAGGAGAGGAGCGACAGAGCA CATGATTATGACCGGGGCTTGCTGCTGA GCTGCAGGGGTTCAGAGTACTGCTACCT GTGCAATGGCAGCTTCCCCAGAGCGCCC AGGGGCTCCGAGGCCACAGACAGAAAA TATCTTTGCTACCACGTGCTGAAAATA | 0.018924879 | 0.010554527 | 5.80E-06 |
| 554 | 3355776 | 9 | FLI1 | AGAAGAGGAGCTTGGGGCAATAACATG AATTCTG | 0.010763744 | 0.009348037 | 6.32E-06 |
| 1467 | 3355783 | 9 | FLI1 | CGGGCCCTCCGTTATTACTATGATAAAA ACATTATGACCAAAGTGCACGGCAAAAG ATATGCTTACAAATTTGACTTCCACGGC ATTGCCCAGGCTCTGCAGCCACATCCGA CCGAGTCGTCCATGTACAAGTA | 0.000731459 | 0.00654568 | 4.54E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 971 | 3357277 | 4 | RP11-700F16.3 | CATGAAACTTATATGTAGACGTTCCTAA TTAGTGGCGTGTCTGATACCAAACTAGG TATCTTTTAAATTTTTATTATTCTACTATC AGTTATATTCATTTTTCCCCTCATAAAAT ATTCCTTAAAGTAAAGAATAAAATTTCA CAATTCATTTCAGACTCTTCTTATCCTCC TCCCCTCCAAAATTTCTACATAACTGCAT GGGGTCAGTTACAGATACATCCAGA | 0.000111639 | 0.013337881 | 8.58E-06 |
| 516 | 3357313 | 3 | ACAD8 | CTAGAAGATAGAATTGTGCTGGGCTCCC TCGACCTCACTGACTTTCTCACCTTCTCT CTGCTGCCTTTTGATCCCTCCTC | 2.85E-06 | 0.014817037 | 1.29E-05 |
| 1814 | 3357388 | 2 | GLB1L3 | CCACTCCCGGCCGTGAACATATTTTTTGG GTTGCTGGAGTTCATCTATAAGTCATTTT TGAGGAATAAGATTTATGTTAAGACTAT CAAACACAGTGTTGCCTACAATAGCAAA AATGTGAAAATAACAACAACAACAAAA CAGCAGAGGAATTGTTATGTATTTTGTA GTCTATCTATATGATGCCTATTTTTAGGC TTTAAAAAGTCTTCAAAATCTTTAATGAC TGATTTATCTAGTTAAATGCTTAATCCTT AGCAGGCTCTTATTCTTTAATTAAACGTG CCTTTGAGTAGATGTG | 0.00180613 | 0.008448428 | 5.79E-06 |
| 1086 | 3359084 | 3 | H19 | AACCACTGCACTACCTGACTCAGGAATC GGCTCTGGAAG | 2.99E-05 | 0.013078059 | 7.77E-06 |
| 528 | 3359501 | 3 | NAP1L4 | GATATTTCCCGCCAGTCCATCGTTGGTTT TTTTAACCTCACGCTAGTCTTTTTTGCGG TGGAGAAGTTTTTCTTGTTCATGGCCCTA TCTGTTGAGCTTTCCCAAAATAGCTTCTA GTAAGTGTTGTGTACTCCAAGCAATCTG TC | 9.46E-05 | 0.014646313 | 1.11E-05 |
| 842 | 3360089 | 3 | OR55B1P | TGACAGTGCCCTTGGTAGTACTAACTGC AAAAGCCCGATTCTGCCGGACAGCAGTG ATTCGACACTTCACCTGTGAGTGCATTGC ACTGCTGAGCATAGCTTGTGGAGACCTG ACCTTCAACAACTGGCTGGGGCTGGCTA TGTGTTTGGTCACTGTAATCTCTGATATG GCCCTGCTGGGGACCTCCTACACCCACA TCATCTATGCTGCCTTCCGGATCTCTTCT TGG | 0.006167603 | 0.010590966 | 7.17E-06 |
| 1780 | 3360163 | 1 |  | CTGGTGGCTCCCAACATGATAGGACACA GAAACTCATGCTCAATGGTACCCGTACT TCGATAAGGAGCAACAGCAAAGTCAGAT GGTGGAAGATCTGTCAGGTGTTTACTTA TGTTGTAGATATGGTTACAAAGCTCAGG GAGCCCCTGTCTAATGGGAAATATGGCT ACCAAACTGATGATGGCCTCCCAGGGAA TCCAATTCTGC | 0.002951948 | 0.006890013 | 7.80E-06 |
| 430 | 3360381 | 9 | OR52A1 | CTACATGCCCTCTGTGTTGACACTAGTAG GGATCCCAGGCCTAGAATCTGTGCAGTG CTGGATTGGGATTCCATTCTGTGCCATTT ATCTCATTGCTATGATTGGAAATTCCTTG CTTCTGAGCATCATCAAATCTGAGCGCA GTCTCCATGAGCCCTTGTACATTTTCTTA GGCATGCTAGGAGCCACAGACATTGCAC TTGCTA | 0.000412342 | 0.009965671 | 3.84E-06 |
| 611 | 3360900 | 1 |  | CCTGTTAGGCCAGAAGGAGACTGCACCC TTGGACTGGCAAGTCAGTGCAAGGCCCT GCTAATAGGACTATTGAAGACTCTCACT ATGGGTTTTCTGTGGGGTGTTTGTTTCTT GGGGTGAAAGCTTCCCTCTCCCCAGGCA GGCCCAGCAAAATCTGTAGGA | 0.000148906 | 0.009149581 | 4.11E-06 |
| 230 | 3361622 | 5 | TUB | AGTGAGTCGGCCTCTTGAACTGCTCAGG AAACATCCCCAGATGGAGAGAGAGAAA CAGGCAGTGGGTGAGACCAGAGCTCCCA CCTGAACACAGTCCCCAGCACACATTT TTGACTGCACCCCGAGTCCCACCAGGGC CCCTGTACCACTTCTACAGCCCACAGGA TCAGGCCCACTCATCTCTACTAGGCAAA GATTCAGGGCAGGCCCAGCTGGAAGGA GGCGGCACCCCCAGCCCAGTGTAATCAA | 0.000457168 | 0.017258817 | 1.23E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GTCAACAGCCAGACCAAAACCTGTGATC | | | |
| | | | | AGCCAACAAAGTGCGCACTCAAAAGTTC | | | |
| | | | | TGGGCCACCAAACCATACTGAGCCTGAA | | | |
| | | | | CAGGGGCAGGGAGAATGTCTGAGAGGA | | | |
| | | | | TATGGCCATTGAAGACGGGGAAGAAAG | | | |
| | | | | AACAAAGGCTGCATCTTCTGGAAGAGAC | | | |
| | | | | CACAACCAGGGCAAGCACTCCAGGGAG | | | |
| | | | | CCTACGAGGGGCTCTGCGGGGATGAGC | | | |
| | | | | CCATGGGAGGCTGGGGTGTAGGAGTGCT | | | |
| | | | | CAGAACAACAACTCTGGGACACAAGAA | | | |
| | | | | GCTACAGGCACCAACAGTGAGGTCTCAG | | | |
| | | | | AAGGGTCCCAGCTGGTGGCCTCCAAATT | | | |
| | | | | CTCCATACTGCAGAACCCCAATCTGCTC | | | |
| | | | | AAAATCCTTGAATGGTTTCTGATTGCTCT | | | |
| | | | | TAAGCTGAAGACCAACATTCTCTCCCTTC | | | |
| | | | | CCCTAGGTCTAAAATAAACACATACTCC | | | |
| | | | | CCACCTCTGGGGCACCAAGAGTTGCAGC | | | |
| | | | | CACACCAGGCTGGTCTGTTGCCTCACAT | | | |
| | | | | GCACTGCACTCCCTCTTGCCACAGGGCC | | | |
| | | | | CTTGCTCCTGCTGCCTGCACTGCCCTCCC | | | |
| | | | | CCTCGCCCCCCTCAGTGATCAACTCCCAC | | | |
| | | | | TCATCCTGCAGATTTCAGCTTGGATGTCA | | | |
| | | | | CCTCCCGAGGGACGCTGTGCCTGCCTCC | | | |
| | | | | CTCGTCAGAGCAGGTGTTGTCATCTACTC | | | |
| | | | | ACAGAATTTGGCTTCCTTCCACAAAGCA | | | |
| | | | | ACCCCGTGACCATCTGTTTAACATTGTCT | | | |
| | | | | CTCCACCTAGACTGTAAGGTCCGTGAAA | | | |
| | | | | GCAGGGACCACACCCATTTGTGCTCACT | | | |
| | | | | TGGGACCTACAGCCTCTA | | | |
| 1111 | 3361630 | 2 | RIC3 | GTAGGAAATGCTCTTGGTCACATCAGAA CTCTAGATCTGGGGAATA | 0.010262873 | 0.007017678 | 4.08E-06 |
| 91 | 3361748 | 1 | | AAGCATTGAATGGAGCACCTACCTGCCC CCAGTCAGAACATCCCCATCTCGACTGG TGATGAGTCAAATGCAGGGATCACAGTG CATGGGGAGA | 0.001151831 | 0.018169375 | 1.73E-05 |
| 122 | 3362161 | 2 | NRIP3 | AGTCAGTTGTCATGGGGTCATTCCCTAG GCCCCCTTCCTATCAGCCTCTACCTAAAG AAGCTAGATAGGAAGCTAAGCACAGCC ATGGTTGGGAGGCTATATCTAAAGCTCA TGAGGGGTGATCCCGGGGTTACCAGCCT TCAGCACTCCCTCTAGCAACACCCCATTC TCTTACCTAGCGGGGATTTGTACCTTTCC ACTGAGGCCTCTCCATGCTCMCCCTAC CTTTCATGGCAATACTTTGGCCTGCCTCT TATCCTGGTACTAAGTTGAAGTAAAGCT CACCCTTTACTTCCCTACTTGAAAGTTCT ACTCTGAGCCTTGACTCTTAGCCACAGT G | 0.007173756 | 0.01771743 | 1.45E-05 |
| 649 | 3364941 | 9 | ABCC8 | CTTCCTGACAGCGAGATAGGAGAGGACC CCAG | 0.001173835 | 0.011380468 | 9.19E-06 |
| 242 | 3365534 | 2 | SPTY2D1 | CAGATGCCAGCCTTGATCCTGATGAGCT ATGCACTCTAATGTGGGGCCACTCACCA GTCAGCCAATCTTTTATTGTTCCTTTGCT ACTTTGAAAGGAAAAAAAAGGTTGTCTC TTGATTTCTGTAATTCTTCTGCTGATCTG TGAGTAGGGCACTGCCCTGCTCCCAATC AAACTTAGT | 0.000208981 | 0.010413807 | 5.07E-06 |
| 1417 | 3366734 | 5 | LUZP2 | TGCTCCTTTCCCTTATGTCAACTCTCCCA CAGGCTCTAGGGAATCCCTTCTCCTCTCT TAATGGCAAGCA | 1.89E-05 | 0.00914798 | 8.89E-06 |
| 457 | 3369637 | 5 | LDLRAD3 | GCTTCTTGTGTTCCCACAAAACAGCTTCT GTTCAAACTTCTGCCCAGAGCAACTCCA TCTCCAGACACCTCTCCAACCCCAGTAA AAATCCCAACTTGTGTAAACACGCAAA G | 0.00020038 | 0.010462696 | 7.14E-06 |
| 425 | 3370248 | 6 | | TTTAATGGCAGTGTGTTTTAATGGCAATG TGTTTTATTTCTCTGGTGGAAAAAAGGGT TATGCTCCAGCGACCTAA | 0.008126841 | 0.0128565 | 1.47E-05 |
| 887 | 3370702 | 3 | RP11-384E5.2 | CGCAGCCTGTGGCCTCCGAGATTGGCTT CTCTG | 0.0007279 | 0.006946076 | 3.70E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
| --- | --- | --- | --- | --- | --- | --- | --- |
| 735 | 3370815 | 6 | | TGTGCAAAGTACGTTCCCGAGAATTCAG TGAGTTCTTCTGGACAAAATAAAC | 1.54E-06 | 0.013058631 | 1.33E-05 |
| 505 | 3371611 | 9 | AMBRA1 | AGGATCCAGAGAGCACCCAATTTACCCA GACCCAGCGAG | 0.004360173 | 0.007627791 | 2.57E-06 |
| 434 | 3372262 | 2 | CELF1 | CTGTACAGCTACCTTCTGGGAAATAGTTT TTGACACCTATTTTTCAGATTCTTGTCCG GAATTTCTGCTGCTCTTTTCAAAAAAGG GCATTAACAATTCTCTGGAAATAAAGCA CCTGTTAGCCTGACATATGCAAAAAGCA GGGCGGCATCACCCATTACGAGCTCCCC CAGCCAGCAGTCAGTATTGGATTGGCCT TGCC | 1.18E-05 | 0.011210977 | 4.51E-06 |
| 427 | 3374540 | 4 | RP11-142C4.6 | CAAGTTGTCTTTGTTATCGGCATCATCTG TTGCTTTCTGAGGGAAGTATTTTGAGTTC TCCTACTGAGACTGTGGATTTGCCTATTT CTTTTTGTATGTCAGCTTTTGCCATATGT ATTTTGTAGTTGTGTTGTGAGGAAGATTC ATGACTTATCTTGTGGGAGAATTCTGTAT TTAGCAGATTTTCGTCTTAAGTTCTGTTT TGCTTAGTATTGATGTTATTACTTTGCTT TTTCAGTTTCAAAATCATTTAGTATATCT TTTTCCTTTCTTTTAGCCTTTGTGTTTTA TTTCAGATGTGCTTTCTTATGTACTGACT GTGATCCCCAAATTCATATGTTGAAGTC CCAACTCCAAATGTATTTGGAGGTGGGC CTTTCAGACGTAATTGAGTTTAGATGAC GTCATGAGGGTGGAGCCCCCATGATGAC ACTAAGTCCTTCTAAGAAAAGGAAGAGA GTCTGAGCCCTCCTCTACACCATGTGAG GGCACAGAGAGAGCAGCCATCAACA AGCTGAGAGAGGAGGACTGAGAATGAA ACCTACCTCGCCAGAACCTTG | 0.000148906 | 0.011207134 | 8.37E-06 |
| 634 | 3374581 | 4 | RP11-142C4.6 | GTTAGGCTCAGCTTATTATTATGTGGGG GCTCAGCGTCTATACCCACCTGAAGCTG GGCTGTCCATGAGGCTTCAGTTCACTAA CCAGATGTGCATGAAACAGATACAAAA GGGGAAGCCTTTAGGGCCAAAAAATAG ACCTAGGTTTGTATTACTATTTCAGCTTA ATCGTGTATACCTTGTGTTTCCTCGGCCA ACAATGGCTAATTATGGTAAATACTATT TAGAATTATGTGCTATGTACTAAGTGTTT GACATATGGTATCTCATTT | 0.013588933 | 0.010869048 | 7.19E-06 |
| 1090 | 3375092 | 2 | SLC15A3 | TTGCTTCACTCTACCGGACAGACGGCAG CAGTCCCAGCTCTGGTTTCCTTCTCAGTT TATTCTGTTAGAATGAAATGGTTCCCATA AATAAGGGGCATGAGCCC | 0.000358678 | 0.009310369 | 7.70E-06 |
| 160 | 3375544 | 2 | FADS1 | ATGAGCGTCCTAAGGCATGTTGGGATAG GGTCAGATGCACCCACCCATGGAGAGGTT TGTCAACACAAAGACATGGAAGGTTAGA GGTTTGTCAACAAAAAGACATGGAAGGT TAGGTTTGTCAACACAAAGACATGGAAG ATTAGAGGTTTGTCAACACAAAGACACA GGAAGAATGGGCTGCAGAAGATTTAGAT GTTTTCCATTTGGGCACATTTTACTTAGC TGGAGAA | 2.85E-06 | 0.023685263 | 2.93E-05 |
| 1749 | 3375547 | 2 | FADS1 | GGAGGGACCTACTGAACCCAGAGTCAGG AAGAGATTTAACACTAAAATTCCACTCA TGCCGGGCGTGGTGGCACGCGCCTGTAA TCCCAGCTACCCAGGAGGCTGAGGCAGG AGAATCGCTTGAACCGGGGAGGTGGAG GTTGCAGTGAGCTGAGATCACGCCATTG TACTCCAGCCTGGGCGACAGAGCAAGAC TCCATTTCAAAAAAAAAAAAAAAATCCA CTCATATAAAAGGTGAGCTCAGCTCACT GGTCCATTTCTCAGTGGCTCTCCATCCT CATTTGCAAACCTCAGAGGGATAAGGCA GTTGAACCTGATGAGCAAGAATTATAAC AGCAAGGAAACATTAATGCTTAGAATTC TGAGATCCAGCACAACTCAGTCTGTGGG AGCTCAGCTCGCTGCCCAGGGATAGGTA | 0.002152759 | 0.00685867 | 2.62E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TGACCTATGTCTGCCTTAGGCTGCTGGG AGATGCCATTCTCCAGTTTCAGAAGCAG GCAGGGCAAAGGTCAAGACTGTGGTATT GGGGTCTTTTGGCTCTGAAGGATCCTGG AACCACTGATTTTGGTTTATTCCCTCCAG GGTCTAAAGAGAACA | | | |
| 2074 | 3375864 | 2 | MTA2 | CGGACTTTCCTAATTGGAGTTTGAGGCC CCTAAGCTGGCATCAACCCCAGGCCACG CTCGCTCTTTCCTTCCCTCCCCTCCCCCTC TGCCTTTTGTACGCCAGTTCTCAGAAA | 0.000461778 | 0.007768584 | 5.69E-06 |
| 1462 | 3376302 | 3 | SNHG1 | CTGTACTGTACGCAACAAATGTCAGGGC CCTATTGATTTGTCTGAGGTGTTAGTGAA GGGTG | 0.000579253 | 0.008432056 | 3.82E-06 |
| 495 | 3376751 | 9 | MACROD1 | CTGAGCACCTCCACCGACTGGAAGGAGG CGAAAT | 0.001974641 | 0.014172182 | 1.21E-05 |
| 126 | 3377027 | 9 | PYGM | AGAGAGGGAATACAAAGTCCACATCAA CCCCAACTCACTCTTCGACATCCAGGTG AAGCGGATTCACGAATATAAACGACAGC TCCTCAACTGCCTCCATGTCATCACCCTG TA | 0.00035324 | 0.01933795 | 1.59E-05 |
| 1872 | 3377621 | 7 | NEAT1 | GCTACAACATAGACGCATCTCGAGGACA CTGTGCTCAGAGAAATAAGCCAGTCACA GACAGACAAATACTTCATGATTTAACTG ATATGAAGTGCTTGGAATAGTCAAACTC ACAGAAACAGAAAGTAGAATGGGGTTG CTGAGGCTGGAGGGAATGGAATGTTTAA TGTTATTTAATGGGTACAGAGTTTGTTTT GCAAGATGAAAAAGTTCTGGAGATTGGT TGTACAACAATGGCGACATACTTAACAC TACTGAATGTATACTTAAAAATGATTCA GATAGTCAACTTCTATTATATGTATTTCA CCACAAAAATTTCTTAAAGTAGCAAGAA ATAAATAAAATTGTAAAAACCTGATGTT AGTGGCTATGTAGGGAAATGGATATCAT ATACTCACAACAGGAAGTGTAGCTTTCT GGAGTCATTTGAGTCTGTGAAGAGAGTT ATAAAACCATAAGTGCTCACTGCCGAGG CAATGCCACTCCAGGGGATACATGTGTA CACTAAATTTACAGAGATGCTCACAGCT GCACGATTTAAAGTAGTCAAAACAGTTT AACAGCTCAAGAGATGGGCTACATATCC TTTAGTATAAGCACAATGGCATAAAATC ATGCAATCATTCATTCATGATCTTTTTTG AGCACGAACAAGCAGATGAAAGTTATGC TTTCCACAGAAAAATACAATTTCAGAGC ATTTATAGACTTCTAGAAACCCATCCAT GGGACTTCCTTTGGGAAGGTTAAGAATC CTGAGAAAAAGCCTCTTCAAATGTGTTT GTGAACTCTGCCGGTACAGGGAAATA | 2.62E-05 | 0.008003529 | 4.98E-06 |
| 442 | 3377625 | 7 | NEAT1 | ACCATAGGAGTTACTGTCTGTATTGTCCT AGTTTTTGTATTGGATAGGAGATTCAGA AATGCTTACCACATTATTAAAAAACAAT TAAAGAAAGCAAGTAAAAGAGAGCCAT GTTGTGTCCTGAATCAAAGATTAAGATT GAGATTTACCCAGTTCTGTGTATTTGAGT TCCAACAGAGAGAATATTCTTGCCTTAC AGGAGTGTTCTAGCCTCCATTTACCAGA TTTTAAAGCATAATGAAAAGTGATGATC ATTACATTCCATTGCATTTTATTAACAAC AACAACAAAAACTGGAGCCTAAAATTTC CAGAAATAGATCCAGAGAGAAAATGTTA AGAACCATTTGATCTAGCAATCCCACTC CTGGGTATCTACCCAAAGGAAAAGAAGT CATTATACCAGAAAGACACTTGATGGCA GTACAAGTCACAATTGCAAAGATGTGGA ACCAACCCATCAACCAGTGAGTGGATAA ATAAAATGTGGTATCTCTACACCATGGA ATATGACTTAGCAATAAAAAAGAACAAA ATAATGTTTGTGGTTTTTTTTTTTTTTGCA GCAATTTTGGATGGAGCTGGAGGATATT | 1.99E-06 | 0.018865238 | 1.97E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 85 | 3377627 | 7 | NEAT1 | ATTCTAAGTGAAGCAACTCAGGAATGGA AAACCAAATACTGTGTGTTCTCACTTATA AGTGAGAGCTAACTTATGGGTACAAA CAGCTGCAGCCACTACGCAGTTTTACCC CAGTTCCACGGCACATGAGGAGAGGACC AACATTATTCTATTTTGGCAGCACGTGCT TTCAACCCATCTCACAAAACAGTGTCAC CAACCAGATGTGCCAAGAGCCAGAGCA GGTGAAGACACCTACAGATGCTGCCTCC TCTGGACACTGCCTCTGGGTGCCTCAGCT CTGCACCCAGAGGGATGCAAAAGAGATC CCCGCAGCACACTTTGAGATGGCTA | 0.002805201 | 0.030343821 | 4.67E-05 |
| 1514 | 3377629 | 7 | NEAT1 | CACACATCTATTCATAGGTGAAATTAAC TGGAAGGAAACTAGCAAAGCATTTGCCT TTGGGGTCAGCACAGGAGCAGAGGCCCA GGCAGGGCCTTGCTTTGACACACAGATG ATGGGTCACACAGTTGTCACCTTGACAG AAGAGTAACAGGGACAGCACACCAGTC ACTCTAGGAGCTGAGGCCAGAGGAACTC AGGTATTTCCTTCTAGAGGTAGTAAGTC CA | 8.09E-05 | 0.009289123 | 3.99E-06 |
| 826 | 3377633 | 7 | NEAT1 | CAAATTAAATAGACGTGAGTGGATGGAA AGACGTACCTTATTCTTGCATAAGAAGA CAACGGCATGAAGACATCACAGGGAAG GTTAAGGTAAACATGCAGCCTGGAATAG C | 3.71E-06 | 0.014719313 | 1.56E-05 |
| 1790 | 3377635 | 7 | NEAT1 | TCCAGGGAACATACACATATGGCCAACA GCACCAGCAAAGGTGCTTGATAGCATCA CTCATCAGAGAAATGCAAATCCAAATGA CACCAGAGGCTACTTCACACTCATTAGA ATGATTATAACCAGAAAGTCAGATAATA ACTAGTGTTGGCAAGAATGCGCAGAAAT TGGAACCCTCTTACTTACTGGTG | 0.000417578 | 0.006683799 | 4.19E-06 |
| 1329 | 3377637 | 7 | NEAT1 | CAGCGTCTTAGTCTGTCGCCAAGGCTGG AGTGCAGTGGCGCAATCAAAGCTTGCTG CAGCCTTGAACTCCTGGGCTCAAGCAAT CCTCTTACCTCAGCAACTAGGACTACAG GCACATGCCACCACGCTTGGCCTTCTAA TTTATTTCTGTGTCAACAAAATAAAACTC AGGCCTAGGAATAGCTTGGTTCAGAAAT CACAGAGGGACTTAGTATTCCATTAATA CAAATGGAAACATTAAGTTCATCATCAG ATGATAAAAGGAAAAAAAAAAACCTGA TACTCATCTCAAAAGACGCAGAAAAGAC ATTTGCATAAATCCAGTACCTATTATTAT TTCAAATTTAAAAACTTCTTCTTTTTTAA GAGATAGGGTATCACTATGTTGCCCAGG CTGATCTTGAACTCTTGGCCTCAGATGAT CCTCCTGCCTCAGCCTCCCACAGTGCTGG GACTACAGGCATGAGCCACCACACCCAT CATAAATTAAAACTTCTGAACAATCTAG TAACAAATGGAAATGCTTTCCCATGATC CAGCACATCTAGCAGGGGGTGTCTGCTG ACATTCTACACAAAGAGACACACTGGAG TTGTGCTTCTCATCATTTCACATTAAGAA CCCAACTGCACCTTTTTCTGTGCCTCTAA ACACCTAGTCTGATAGGGGACACCC | 9.78E-06 | 0.011817785 | 1.08E-05 |
| 1646 | 3377641 | 7 | NEAT1 | CTGCCTTCGCAGACAGGAATGCTGTCCT TCCAGCTTCTCCTACCCTTCGGGTCAGAG CCCAAAGGTCCCCACCCCTGGTTAGGGC TGTTTTCACTGGGCGGGGGCGGGGGAC TACACTCCTTGGTAACTGTCACAACTGCC CTTAACTAATGATTTGTGCATTGCCACCT GAGGC | 0.000129873 | 0.010091592 | 9.01E-06 |
| 1590 | 3377659 | 7 | MALAT1 | CCTCATTTTGTCCACTGGTGAATTCAACT GGAAGCTCCTTCTATAGTCTGAAGAATA CCATCTGAAAGAACTAGTGGTTCCCAAT CCCCACATTTAAAATGGAATGTTTGGTTT ATTTAAAGTAAATAGGCTATTTTTTCTTA CTGGGTCTGGCTTCTCTGGCCCTTCGCAT | 3.52E-06 | 0.009063684 | 6.47E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
|  |  |  |  | ACGTGTGTCTGCTGAGTGTTCCTGCATGT AAGAATTAAGACCAAGGGAGGGGAGAG AGAAACCCACACATAAACAATGCACTAA AGATCACTGAACTGTTTAAACATTTCCA CTTGCCAGTTTAATTTCTTGAAGACTGTT GCTTGTTTGGAATGTTTCTTGTCACTGAT TTTAAGGTTGCATCTGGAAAAGACTAAA GGCTTCAGTCCCCTCCCACCACCAGAAA TGAACAAAAGCATTTTACCTAAAAATA CACCAGCAAAATGTACTCAGCTTCAATC ACAAATACGACTGCTTAAAACTGCAGAA ATTTCCTCAACACTCAGCCTTTATCACTC AGCTGGATTTTTCCTTCAACAATCACTA CTCCAAGCATTGGGGAACACAACTTTTA ATCATACTCCAGTCGTTTCACAATGCATT CTAATAGCAGCGGGATCAGAACAGTACT GCATTTA |  |  |  |
| 760 | 3378515 | 3 | RP11-658F2.3 | GGAAGTTAGCTTTTGGTCCACCAGCGAG TTTGAATGGA | 1.71E-05 | 0.011361311 | 9.90E-06 |
| 894 | 3379539 | 8 | PPP6R3 | CCATAATCAGGCAACAACCAACTTCCAT GACTG | 3.93E-05 | 0.011032576 | 9.23E-06 |
| 580 | 3379566 | 5 | PPP6R3 | AGTGCTTTGGAGTGTATTTATTTTCAAAA TGATCCATGATTGGTTTAAACATGCAAA GAAAAATGTACTGGAAGCTTGTCAATCA GAAAAGAGTAATTATTCTTCCACTTTGA AAAGTTCATATGAAGTGGGTAAATTCTG CAAGCTAAGAGCTTGGCAAGGGCTGTTG TAAGTTAGTTTTG | 0.006456347 | 0.011482378 | 1.43E-05 |
| 395 | 3379697 | 1 |  | CCCCTTGGCCCTCCTGTTACGCTTGGGGC CCCTCTCCCTCCCCCTCAACCCCCTGGGT CCCCTGCAGCTGCGCTCGCCCTAGACTC C | 0.001001048 | 0.01468751 | 1.53E-05 |
| 290 | 3379916 | 1 |  | GTTAAGGGCAGCCTCGGATCACAGAGGT TCCATTTCCGATTTTCCAGAAGTTGCCGA TTATTAATGATCATTGTTCTTTCCTTCTG GGGCATAACAAAGCAG | 0.002099724 | 0.00944787 | 5.89E-06 |
| 1596 | 3380081 | 2 | ORAOV1 | GGGTCGCCATGAATCCACTTTGGTTTTAA AACCATTCCCGAATGTCCTAGTGGATTG TGTTGTGCTGCCTAAGCTGCCGGCTGCA GGAGCCAGAGAAGTGACCCCCGCGGGA GCAGCGGCAGGTGGATCTCCACGGTGGC TCGCTTTGTTTTTGTTTTGTTTTTTCTTTT AAGACGGAGTCTCACTCTGTCGCCGAGT TTGGAGTGTATTGGCGCGATCTCGGCTC ACTGTAACCTCCGCCTCCTGAATTCAAGT GATTCTCCTGCCTCAGCCTCCCTAGTAGC TGGGATTATAGGCGCCCCCCACCACGCC CAAGTAACTTTTGTATTTTTAGTAGAGAT GGGGTTTTGCCTTGTTGGCCAGGCTGGTC TTGAACTCCCAGCCTGAAATGATCCACC CACGTCCACCTACCAAAGTGCTGGAATT GCAGGCATGAGCCACCACTCCCGGCCTG CTTTTTGTTTTTGAAGACAGGACTTAGGT CTCCTCCTCCCGAACTCTAAACCTGCGTG TGTGGCTGTGCACCGCTCGTTTGTAGCGT CACCTCAGGTCTGGGGAAGTCTGTGCTG GCATCTCCTCATTGTGCCTTCATCAGAGC TGGTGCCTTCGGGCCAGAAAGACTCTCG TTC | 0.000102061 | 0.006925599 | 2.34E-06 |
| 68 | 3380323 | 4 | AP000487.6 | TTCAAGAAATAGTGCATATCTCGTCTAT GCTGGCCGCTGCAGCAACACAGAAACAG GGCCTGTCCACTCCTCAGGATGCTTTAA AGAACAGACAGACGAGCTGGCAGGAAC CT | 0.000119134 | 0.03317763 | 4.24E-05 |
| 1302 | 3380437 | 4 | SHANK2; A001271.5 | TCTCCATCAATCATAGCCCGGTGTGTTTA ACTTAGAGTAGATGGTGGCACCACCCGA TAACAATGGTGGTGGCATTCAGCAGCAG CTCAGAGGGTTCCAGAAGCATTCCTCCA GCCTCGAGGGGAAATGGTGCCTCTGGCT AACGGAGGGAACCATCAAAGCCGGGTA | 0.000378341 | 0.006723456 | 4.70E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | TGGTTTCTTTGATCGTGTTTAGCCGCTTT GTGGCTGAGTAGAGATTCTTCCTTCTTCC TGTCCAGGTAATTAATGAGGGACTTCAA AGGCATGAGGCTTTTCTGCTCCAATCAA TTATTCAGATTGGCATATCCAAAGGTCTC TGAACAGGAAATAGAGAGGAAATGGAT TGCTAAGTGGTTATGATGGAGACTAAAT GAATTACTTGTTAATCACCCTTGTCTGCT CTGGTAGTATCTG | | | |
| 217 | 3381818 | 2 | UCP2 | TGGCTTTGTCTCTAGCCGGGCCATGCTTT CCTTTTCTTCCTTCTTTCTCTTCCCTCCTT CCCTTCTCTCCTTCCCTCTTTCCCCACCTC TTCCTTCCGCTCCTTTACCTACCACCTTC CCTCTTTCTACATTCTCATCTACTCATTG TCTCAGTGCTGGTGGAGTTGACATTTGA CAGTGTGGGAGGCCTCGTACCAGCCAGG ATCCCAAGCGTCCCGTCCCTTGGAAAGT TCAGCCAGAATCTTCGTCCTGCCCCCGA CAGCCCAGCCTAGCCCACTTGTCATCCA TAAAGCAAGCTCAACCTTGGCG | 5.30E-06 | 0.022035487 | 2.14E-05 |
| 997 | 3383041 | 2 | RSF1 | CGCTGGGATCCGCAGAGGAGCCCACTTG AGAGCGCCTCCTGTCGTCTGTAAGGTTG CCTTGCCATCCCTCGGC | 0.039284329 | 0.007912749 | 2.11E-06 |
| 2007 | 3386740 | 6 | | ATCGATAAGTAGCTCCACCTGAAGAGGG ATGGAACCTCTGGGTCAGGAAACAGCTG GAATCCACACTCACCTCATTCCCATTGTT TGGATCATGCTTCTTTCCAACACGTGTTC ACAATCTCCAAAGGGACTGTATTTCTTCT CTGTGCTTAATGTGATTTGA | 8.24E-05 | 0.00957179 | 7.94E-06 |
| 864 | 3387255 | 2 | SESN3 | TCTTCTCTCCAGCTAGGTGCACTTGAGGT TGTTCATAAATGTAAAATTATGTCAGGTT TCTAACATGGGACACTGCACACAGTTGT CTGACCTGATGAACCATCCCATTTGAAA GTATAGATTATTATTATTTCTTGTAGTAT TTGGTTGTTTTCCATCTCATTCATGAACA ACTCAACCTGATAGTAGTATCCAATAAA TGCCTTTCAGGGCTCAGGAATGAATTGA CATCCTAGTTAAGAAATGAGACTTAATA ATGGAGACTGAATGAGGCGGTTTGTATT AAATTATATGCCATGAAGTGTTCATTTTA GCTTTAACCTAATTATGACTGTACCACCA TGAAGTACAGAATGAAAAATTATATATA TGGGGGGGAAACAGAATGAATATCTGAT TCTTTTGAATGCTTGTGGAAATCTTTGAG ATCGTGCAGGGCATACCACAAAATAGCC TTTAGAACAGATACCCAATTTTACAGTTC ATAGGACAACATCAAACATTAGTAAGTC TAAATAAGATGAATAGAATTTTTTGTTAT GTAAATTTTGCTAGAACAGTCTATTTTCT TGCACCCCTCAAGTTAACCTCTTAAAAA AATGAATGTATAATTTCTACCGAAAGAA TATCAGAGAGAATCTCTCTGGCCTATAG TGTTAAATATTGTTCACAAATCCTGATT AGTTAAGTGCATACATTATGAAACTTAC AGAATAAAACTTATTATACATCTCTTTCT TAAATTAATATCTTTACACATTTTCAACT GGCTCCCCAAGTCTGATAAGGAAGGATT AAAAGAAAAAGAAATGTATTAGTTGG GTGGCCAAGGAGTTTCCTTTGTAATGTTG AGAGACTTCCGCTTTCTGAATTTCGCTGG TTCTCTAAGGTAAAAGAGTTAAATAGTA CCCTTGTTCACCAAGGAAAGTGATCCAA ACTATATATCTAGTGCAGATATTTCCTTT GCATTATTTAGTCTTCTCTGGAGAGAAA ATACAGTTTCCCCTTCCTCTTTCTCTTCA CATTTACTCTTTTCAACCCAAAATAAGA GACATAGAAAGCAAACCACAGCCAGTTT GGCATCTTCTCAGTGCTACTAGTA | 1.75E-06 | 0.014386509 | 9.69E-06 |
| 1050 | 3389367 | 9 | CASP1 | AGTCAAGCCGCACACGTCTTGCTCTCATT ATCTGCAATGAAGAATTTGACAGTATTC | 0.005684569 | 0.008445273 | 5.16E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 150 | 3391911 | 8 | ZBTB16 | CTAGAAGAACTGGAGCTGAGGTTGACAT CACAGGCATGACAATGCTGCTACAAAAT CTGGGGTACAGCGTAGATGTGAAAA CCCGAACGCATCAGGTGCAGAGACCGGC ACCCACCGAGAGCGGCCGGGAGCGCAC GGCGAGCTCCGGTGTCACCGCCGGTCCC GCCGAGAGCCGAGGAGGGCCCGCAGCG CTGCAGACCCTCTGGAGCTTCCCTCCCTC CCCTGCAAAAGGGGGTGGGGATCAAGT CCAATCAAGAAAAAGCCCACCACGTTTT CTCAAAGAGAAACAAAACGTAAGCAGT CCCAGTCCTGCTCCCTCCGCCCCCAGAT CTACTCGTCAGCTCCTCCGATT | 0.005359393 | 0.01781851 | 1.50E-05 |
| 1501 | 3392582 | 8 | AP000797.3 | CTCTACCCTTTCCAAAATCAAGGTGAAG GCAAGACGGCCTCTTCCAGCT | 0.00060261 | 0.007086086 | 3.38E-06 |
| 880 | 3393305 | 8 | CEP164 | TGCCTACACTGAGAACTGAATGATGAGT AGGTATTCACTAGACAAAGAAAAAAAG GAAAGCGTGTTCTAACAGATGCATGCAA AGTCCTTCAGCAGAAGGCAACACGAGG CAAGAAGCAGCACAGTTGGATAGGATGC TGGGGAGGCCAGTGGGAGCCAGGCCAT GCAGACTTGCCCTTTATCATAACAGAAC TAGGGCTGGGCACAGTGGCTCACACCTG CAATCTCAGCACTTTGGGAGGCCAAAGC AGGAGGATCGCTTGAGCCCAGGAGTTCA AGACCACCGTGAGCAACATAAGACGACC CTG | 2.01E-05 | 0.008257925 | 3.45E-06 |
| 1627 | 3394419 | 9 | THY1 | GAAGCCTCAAGTTCCAGTGCAGAGATCC TACTTCTCTGAGTCAGCTGACCCCCTCCC CCCAATCCCTCAAACCTTGAGGAGAAGT GGGGACCCCACCCCTCATCAGGAGTTCC AGTGCTGCATGCGATTATCTACCCACGT CCACGCGGCCACCTCACCCTCTCCGCAC ACCTCTGGCTGTCTTTTTGTACTTTTTGTT CCAGAGCTGCTTCTGTCTGGTTTATTTAG GTTTTATCCTTCCTTTTCTTTGAGAGTTC GTGAAGAGGGAAGCCAGGATTGGGGAC CTGATGGAGAGTGAGAGCATGTGAGGG GTAGTGGGATGGTGGGGTACCAGCCACT GGAGGGGTCATCCTTGCCCATCGGGACC AGAAACCTGGGAGAGACTTGGATGAGG AGTGGTTGGGCTGTGCCTGGGCCTAGCA CGGACATGGTCTGTCCTGACAGCACTCC TCGGCAGGCATG | 0.00080419 | 0.007549673 | 4.89E-06 |
| 1415 | 3397595 | 2 | ETS1 | ATCAGTGGATTCTCGGGITTTGGACTTA ATGTTGAGCTAAGAAGCATTAAGTCTTT GAACTGAATGTATTTTGCATCCCTGGTTT TGGACGACAGTAAACGTAGGAGCACTGT TGAAGTCCTGGAAGGGAGATCGAAGGA GGAAGATTGACTTGGTTCTTTCTTAGTCC TATATCTGTAGCATAGATGACTTGGAAT AAAAGCTGTATGCATGGGCATTACCCCT CAGGTCCTAAGAAATAAGTCCTGAATGC ATGTCGTTCCAAACTAACACTCTGTAATT TTTCTTTTATGTCTTATTTTCCAAGAGTC CTCCATTTTTGCACCCCCTCACCGCCAA CTCTGTTATTCAGTAGA | 0.042209752 | 0.009491646 | 1.11E-05 |
| 387 | 3398942 | 5 | NTM | CCTCTCTAAGGCAGTACTAGCGAAGACC GACTCAGATGCTGCCACA | 0.005672651 | 0.012339334 | 1.02E-05 |
| 319 | 3399568 | 4 | NCAPD3 | TCACCAGCAGGAATACGAAGTGTCCCTC TGGGTAGCCAGAACGAGCTGACTTCGT TCCAAGGGGAGGGTGTTGAATTGAGGAC TGAAGGTGGAGCAAGAGCCAAGGTCCCT CAGGGTCTTCTGTGGAGATTTGGGGCTTT TGTCAAAAGCTACTCAACATGTTTCTAAT TCTTTTTCCCATTTAGAATATATGAGTA GTATTTGTCCCCACCCTATCTTACAAAGC CTTCAGAGTGTTTTTGAGGTAATGCTTACA AGTCTCCCAGAGAAAAGCAGAGGTCCT CTACATCCAGTATCATAATGAAAAGCAA | 0.005792861 | 0.010903697 | 8.85E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 921 | 3399590 | 9 | NCAPD3 | AAATAAACTTACATAGTGTGGTAGGGTG GCTCTACTCAAAGAACTAGA GAGGATCAGGGATGAGAAGACCAACGT TAGGAAGTCTGCACT | 0.001666372 | 0.010212699 | 6.68E-06 |
| 1171 | 3399602 | 9 | NCAPD3 | GCAGTGTAGCCAATCAAGTATTCCACCC AGTGATGTTTGACAAATGCATTCAGACT CTAAAGAAGAGCTGGCCCCAGGAATCTA ACTTGAATCGGAAAAGAAAGAAAGAAC AGCCTAAGAGCTCTCAGGCTAACCCCGG GAGGCA | 0.001095886 | 0.008878141 | 5.06E-06 |
| 1498 | 3401999 | 4 | KCNA1; RP3-377H17.1 | ATGCTTCTGATTTTCTACCCCCGTATCAC TTTCTATTTCTCTGCAGCGTGCATCGATC GCCCTGGTGGGAGCTTAGAAGGCGGCAG GCGAA | 0.030501101 | 0.00691775 | 4.16E-06 |
| 431 | 3402336 | 3 | CD9 | ACTAGCTTGAGTGGATTCATCTTGCTGG AAAGAGCTGACAGACTGGACCAGTTTGC ATTCCGAATGTAGGGATTCCCGTGGATA TTCTCTGTCCTGGATTGAGGGCTAATGG GCACCTTCCA | 0.000194662 | 0.013880303 | 7.94E-06 |
| 172 | 3402965 | 2 | RPL13P5; LRRC23 | GTTAACCCTTCTCTTGCTGCGGCAGAGTC CGCACCCGGGCAGGCCCATCTCAGAATT AACGCTTTGATGGCATCACCGCGTCGGG AATCCCTGGGGATGGTGTTCTCCACCGT CAAGACCTTTGAGCCGCCTGAGCGA | 0.000284076 | 0.015901702 | 1.90E-05 |
| 596 | 3404455 | 4 | CLEC2D | CACTAGACAGCAATTCAGAGCCTCCAAA ATAAAGAATATTCATAAAGTAACAATA GAGGTAAATATAAAACCCAGAATTACTA CATGTGTCATATAGTTTATAACTTCTCCT ATTTATAGCTTTCTATATTTATATTTATCT ATAACTTCATAGGCAAATGAATAAAAAT TATAAATATGATAGTGGTCATATAATGT ATAAAGATGCAATCTGTGACAGTCTTAT GAAGCAGGGATGAAGACATATAGGATC AAAATGTTTGCATAGTTATTGAAGCTAT GTTGATATTATGAAATTATATTGTTACAA GTTTAAGATGCTAATTATAATTCTCAAG GTAACCACTAATAAAATTACCAAAATTA TGCAGAAAAGGAAAAAAGAAAAACAAT ACACTATAAAAACCAATTAAATACAAA AAAAGTCAGTAACAGACAACTTGAGAA ACAAAGACATATAAGATATAGAGAAAA CAAATGATTAAATGGCAAAAGTAAATCT TGTTTTAGTAATCACATTAAATAGAAAA GGATGAAGCCATCCTATTAAAGGGCTGA GACTGACAAGTTGGCTAAAAACTAAAAT AAATTAAAAAGAAAAACAAGACTCATCT ACATGCTGTCTATAAGAGACTTGCCTTA GATATAAGGACACAAAGAAGTTGAAAG TAAAAGGACTGAAAAAGATATTCCATAC AAACAGTAGTAACCAAGATAGTGCCGAG TGGCTATATTTTTGTCAAACAAAATAAA CTAAAGTAAAATTTACAAGAGAAAAAG AAGGGCATTATGCATTGACAAAAATTTT GACATAGCCAAATAATTATGTTATAAAA TATATGTACTTAATAATACAGCCTCAAA ATATATGAAGCAATAATTGCTATAATTT AAGGGAGAAAAGAACAGTTCTATGAAA AGTTAGAGAATGAAATATTCCACTTTCA ACATGAGATTAAACAACTAGACATAAGA TCAATAAGGAAATAGAAAATTTGAACAA CACTATAAACCAATTATCCCTAACAGGC ATATACAAGAATCTACCCAACAAGAG CAGAATATTAATTCTTCTCAAATGCACAT GGAACATTCTTAAACCATATGTTAGGCC ACAAACAAGTGTTAGTAAGTGTGAAAA TTTGAAGTCATAAAAAGTATCTTTTGCA ATTACAATGGAATGAAGCTAGAAATCAA TAACTAGAAAAACCAGAAAGTCACGC ATATGTAGAAATTTAAAAACCCGCTCTT CAACAGCCATTGGTCAAAGAAGAAATCA | 0.004749446 | 0.013360002 | 1.34E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 501 | 3405316 | 4 | LOH12CR1 | CAAGGGACATTAGAAAATACCTTGAGAC AAATGAAGTAAAAATACAAATAGCACGT TTATGGTATACACTGAACA AGCTGAGGTGCTGTTAAGAAAATTCTGA TGTCTGGGTCTCACTCCGAACCGATTAG ATCAAAATCTTTGAAGGGTGATAGGGTT AGGGCGGTGGGATGTTGGGTATTGGTAT TTATGAAGGTGCTCTAGGTGATTCTAGT ATGTAACCAGGGGAGAACCAGTGTTTTG GAGCATTCATTTAAAAATAAACTGACTT TGGCGGGCGACATG | 0.008884278 | 0.011806462 | 6.56E-06 |
| 237 | 3405606 | 2 | GPRC5A | GACTCCAGTTCTTAGAGGCGCTGTAGTA TTTTTTTTTTTTTGTCTCATCCTTTGGATA CTTCTTTTAAGTGGGAGTCTCAGGCAACT CAAGTTTAGACCCTTACTCTTTTTGTTTG TTTTTTGAAACAGGATCTTGCTCTGTCAC CCAGGCTTGAGTGCAGTGGTGCGATCAC AGCCCAGTGCAGCCTCGACCACCTGTGC TCAAGCAATCCTCCCATCTCCATCTCCCA AAGTGCTGGGATGACAGGCGTGAGCCAC AGCTCCCAGCCTAGGCCCTTAATCTTGCT GTTATTTTCCATGGACTAAAGGTCTGGTC ATCTGAGCTCACGCTGGCTCACACAGCT CTAGGGGCCTGCTCCTCTAACTCACAGT GGGTTTTGTGAGGCTCTGTGGCCCAGAG CAGACCTGCATATCTGAGCAAAAATAGC AAAAGCCTCTCTCAGCCCACTGGCCTGA ATCTACACTGGAAGCCAACTTGCTGGCA CCCCCGCTCCCCAACCCTTCTTGCCTGGG TAGGAGAGGCTAAAGATCACCCTAAATT TACTCATCTCTCTAGTGCTGCCTCACATT GGGCCTCAGCAGCTCCCCAGCACCAATT CACAGGTCACCCCTCTCTTCTTGCACTGT CCCCAAACTTGCTGTCAATTCCGAGATCT AATCTCCCCCTACGCTCTGCCAGGAATTC TTTCAGACCTCACTAGCACAAGCCCGGT TGCTCCTTGTCAGGAGAATTTGTAGATC ATTCTCACTTCAAATTCCTGGGGCTGATA CTTCTCTCATCTTGCACCCCAACCTCTGT AAATAGATTTACCGCATTTACGGCTGCA TTCTG | 2.19E-05 | 0.020038313 | 1.78E-05 |
| 802 | 3406085 | 9 | ATF7IP | CTAAATCACACTCCTGTATCAACCATGA GTTCTTCTCAGCCTGTGTCACGACCATTG CAACCCATACAACCAGCACCGCCTCTTC AACCATCTGGGGTGCCAACAAGTGGACC ATCTCA | 6.62E-06 | 0.012402676 | 9.80E-06 |
| 1245 | 3406450 | 8 | EPS8 | GAGAGCATGGCCTGCCAACTTAAACCCA AATCAATT | 0.043006584 | 0.007576256 | 5.93E-06 |
| 590 | 3408793 | 7 | BHLHE41 | CCTCACTCATAGTCAGACTGTTGTGTCTC ACCCCTTACATAACATCCAAGTGAGATT TCTCACAGTGCTACCTTGGCAACAAACT AAAAATATCTAGACAAGGTCTTGGTTTA AGCCTTATTAAAAAAGCTTTCTTTGTGAT TATCTGGTATCTGGTTTGGTCTCCAGAAA ATACATAGACTTGGAGATAGGAAGGCCT CACAGGACTTC | 0.000617654 | 0.008783782 | 3.44E-06 |
| 855 | 3409273 | 4 | PPFIBP1 | AAAAAGCAGGGGTGCTACAGCAAAGAC ACTATCAGATGACAGATGTAGGAGAGTG GTCATGTCAAGAAGCAAAAGGA | 0.030178237 | 0.007142121 | 5.18E-06 |
| 727 | 3411330 | 9 | LRRK2 | TATCCATGTGCCTCTGTTGATCGTCTTGG ACTCCTATATGAGAGTCGCGAGTGTGCA | 0.008812862 | 0.008052347 | 5.33E-06 |
| 1021 | 3412547 | 6 | | AAATCTGGGAGTGTTCTTTGTGAGGGTG GAACAGACTCCCTGTGACAGGGAACTAG ATGAAGGAGTCTTGAGAAGCTGATGATC AGGAGTGGTCACA | 0.001543869 | 0.010561963 | 5.59E-06 |
| 988 | 3413308 | 2 | TMEM106C | CAAACCATGGAGTGATGTGGAGCTAGGA TTGTGAGTGGACCTGCAGGCCATTATCAG TGCCTCATCTGTGCAGAAGTGGCAGCAG AGAGGGACCATCCAAATACCTAAGAGA AAACAGACCTAGTCAGGATATGAATTTG | 3.81E-05 | 0.017324674 | 1.55E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TTTCAGCTGTTCCCAAAGGCCTGGGAGC TTTTTGAAAAGAAAGAAAAAAGTGTGTT GGCTTTTTTTTTTTTAGAAAGTTAGAAT TGTTTTTACCAAGAGTCTATGTGGGGCTT GATTCACCCTTCATCCATT | | | |
| 2027 | 3413826 | 9 | TUBA1C | CTGTACTTTTACACTCCTTTGTCTTGGAA CTGTCTTATTT | 1.38E-05 | 0.009416863 | 6.80E-06 |
| 607 | 3414084 | 4 | RP11-133N21.2 | TCAGACACTCTGCATGCTTGCCAGAGAG CTCGCTAGAGGACGTGCAGAAGGTCAAA GTCCTCCATCACCAGAGCAAGTTCAGCC ACCAGGC | 0.01309721 | 0.011337491 | 8.76E-06 |
| 116 | 3415017 | 9 | SCN8A | GCTGGTGTGTCTCATCTTCTGGCTGATTT TCAGCATCATGGGAGTTAACTTGTTTGC GGGAAAGTACCACTACTGCTTTAATGAG ACTTCTGAAATCCGATTTGAAATTGAAG ATGTCAACAATAAAACTGAATGTGAAAA GCTTATGGAGGGGAACAATACAGAGATC AGATGGAAGAACGTGAAGATCAACTTTG ACAATGTTGGGGCAGGATACCTGGC | 0.005756556 | 0.027631416 | 3.31E-05 |
| 922 | 3415243 | 4 | NR4A1 | TTCCCTTCGGGGAACGTGCATCTGTTTTT AGGAGCGGTGCATGAAGGAGATGGGTG TACGCGCGGGCAGAGAGGATGTTGTAGG GCCGGCATGC | 0.004790078 | 0.00857609 | 7.18E-06 |
| 919 | 3415245 | 2 | NR4A1 | TGAGGCTTGTTCAGCAGAACAGGTGCAA GCCACATTGTTGCCAAGACCTGCCTGAA GCCGGATTCTCC | 0.036791598 | 0.008209899 | 4.22E-06 |
| 511 | 3415254 | 9 | NR4A1 | AGAGAGCTATTCCATGCCTACGGCCTTC CCAGGTTTGGCACCCACTTCTCCACACCT TGAGGGCTCGGGGATACTGGATACACCC GTGACCTCAACCAAGGCCCGGAGCGGGG CCCCAGGTGGAAGTGAAGGCCGCTGTGC TGTGTGTGGGGACAACGCTTCATGCCAG CATTATGGTGTCCGCACATG | 0.000146537 | 0.010832039 | 6.60E-06 |
| 1131 | 3415256 | 4 | NR4A1 | GAAGCTTTCATTTGCCGGGACACTCGGG CCCATGGGATTGCACAGAGCTGGAGGGA GGGGTGAGATAGGGGCAGATAGGGAGCT GCAGGGGTGCCTGGCGAGCCTCTGGTTT TCCTCTGCTCCTCTGCCTGTCCTCTCCCA ACTCAAGGTTCTAGTGGGAAGGGGTGCC CCCAGGCTCTCATGTTCCTGGCGTGAGA TGAAAGGATCCCTGCGGAGGGTTTGGTT CTTGAGGGCTGGGGGTGGACTTGGGAAC AGGCTGTGTGTTTGTCCCAGCGATGGTG CCTGCTTAGCTTCCCGTCCCCACCCCCCA GCCCCTTGGCCCTCTCCTGTCTGCCCTAG GGAGAAGGCAGGTGGACAAGGGCCCAT GAAAAAATACAGGTGTCTAGACTGCCAG GGAGACCCTGGCCCCCAGTAGTGTGTCC TGGGGACTTCCTCAGAGCGAGAAACCTC CCCCAATGTCTTCAAGACTTTTCTCTCCC CCCGCCCAACCCCGTCTCTCCCTCCCTTG CCACCCAAATGTTAGAAAAATAGCTGTG AACAGAGAGCGCTTTTGTCTGCAATGGC AGCAGGATCTGGACGGTCCCCTCCCCTA AGTTCCCCCCTCCCCACCCCACACTCTGA CAGCTTGTTCCGTGTTGCCC | 0.00421284 | 0.007543327 | 3.79E-06 |
| 486 | 3415264 | 4 | NR4A1 | CTTTCCCTGATACACCTGCCTGTGAACCA CCCTGATCGCTCTTCGTGCC | 4.81E-05 | 0.013327502 | 1.58E-05 |
| 1619 | 3416307 | 4 | AC012531.1; HOXC6 | CGCATTCCCGGTTGTTTGCAGAAAATTTA CAGCTGAGTAATAAAAGTTTACGATCGA CTCACAAGTTGGATTGGCCACAAGAAGT CATGTGGATTCCATCCATGAACGTGAAC TTTTTATTGTGGTTTGTCCGTTCCGAGCG CTCCGCAGAACAGTC | 1.54E-05 | 0.007942225 | 4.10E-06 |
| 1692 | 3418367 | 9 | ARHGEF25 | TGAGGGGAGTATATCGGCTTCTGCTGCC TCC | 0.000310049 | 0.007360913 | 4.16E-06 |
| 1520 | 3419870 | 9 | TBK1 | ACTTATCTACGAAGGGCGACGCTTAGTC TTAGAACCTGGAAGGCTGGCACAACATT TCCCTAAAACTACTGAGGAAAACCCTAT | 0.000261519 | 0.008358427 | 3.52E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 888 | 3419989 | 2 | TBC1D30 | ATTTGTAGTAAGCCGGGAACCTCTGAATA TGGCACAGGTTTGACACTGCAGGTCGGA GGAGGAAGACAGTGGCTGCAAAGGCAA AATCGGGTGTTATTTTCCCAAGAGTCCCT TCAGCGTGAGTGCCGGGGTCAGCTCGAA CTGGGAGCCTGTA | 0.000436951 | 0.0081496 | 9.21E-06 |
| 1662 | 3420374 | 4 | HMGA2 | TGCATGGATCTATTAGTGGATGGGCGCC AGAACGACACAGTCAATGCA | 0.00051035 | 0.007578034 | 4.27E-06 |
| 985 | 3421317 | 3 | MDM2 | ATTGTAAAAGCCATCTGGGCTAACATT TC | 0.000444711 | 0.013007873 | 1.22E-05 |
| 710 | 3421365 | 7 | CPM | CAGATACAGGGGACACAAACAGCTCTGT GTTTATGAACTACAACCAGTTGTTGACTT TTGTTTCAAGTGGCTCCCCTTCCCCAGTG CTGTGTGGACGATGGACTGAAGAGGAGA AGGCTGGGAGCAAGGGACCAGTAAGCT GTTGCAGCAGTGCAGGTGAGATATGAGG CCTCAACTC | 0.002052564 | 0.011613351 | 1.08E-05 |
| 613 | 3421368 | 7 | CPM | ACGCGAGTCTGAAGCTCAGGCAAGAGGC TAGAGTTACATCTTTGGAGTCATCAGCCT AATGGAGGACTGTGGCA | 0.017687915 | 0.008834732 | 8.09E-06 |
| 1331 | 3422466 | 9 | TRHDE | GTTACTCAGTTTTCGCCTACACATGCCAG AAAGGCATTTCCTTGTTTTGATGAGCCA ATCTACAAGGCTACTTTCAAAATCAGCA TCAAGCATCAAGCAACCTATTTATCTTTA TCTAATATGCCAGTGGAAACTTCCGTGTT TGAGGAAGATGGATGGGTTACGGATCAC TTTTCACA | 0.003428273 | 0.007617866 | 7.06E-06 |
| 112 | 3426457 | 1 | | GCACTTGACAGAGCCAACTTTAACACAG ACTTTGAGAAGTGGCCCTGATGAAACCC TGGCCAACAGCCAGCCAGCCACTACCCA AAAATGTCTGCCTGAAAGCAGCTCCAGG AGGCAGGCCATGGGGAGTGGAAGTCGG GGAGAAACTGGAAGAGGCGCCAAGCAG CTGTCA | 0.015458225 | 0.015811581 | 9.94E-06 |
| 923 | 3426889 | 1 | | CCTGGTACAGTCGTGGAGGTCCATATGG GTGAAAAGCCCAGAAGTCTACCTGAGCT GAAAGCACTCCCAAGGAGTTTGGTTTTG TTTGGGTTTGTTCTAGGTATGGTCCCAGG GATCCC | 0.000389041 | 0.006909422 | 6.41E-07 |
| 1072 | 3426905 | 1 | | GAAAAGGCTTTGAAGTGTCTGAAGAGGA GAGACAGGGAAGTGACTCACAGCTCAAC AGCTTCACCCTCTGGCTTTGATGGTCCTT GGCTCCGTGATGCTCAG | 0.002836517 | 0.006581456 | 3.08E-06 |
| 783 | 3427524 | 4 | RMST | ATGATATTGATCTCTGGCTTACCTAAGCA TACTGCGTGATAGTAATTATATTGAAAG ACATTTTCAATTAAGTTAGGAAAAGAG TAAATCATGATCAATGAAAACTAAATTT GAACTATTAAGAAGCCTATGGGGAGCAG TTTATGTTTCTGATATGATTTATGCTCTA AAATTTCACTAGTTTCCTTTACACTCTTA ACTTTTCATAGTTAGGCCTAAACTAAAC CAAATATTCATGTGCTTTATTATTCTTCC TTGCTTCTCAGTATCACTTTCCTTATCAC CTAAAAGGCATTATTAAAAATCAAAAAA CAAAAAATCTGCACATCTATTATAGTCT GAATGTATGTTTTAGAGAATAGAAATA AGAAAAAAGGGAGGTATTTAAAATGTTG AAGTAAGTTGTGGCAGACCTGGAAGACA ATGCATGGCTAAAGTACAGAATTACTTT CTCTGAAAATCTTTAAAACAAGGAAAC CAGTTCATGTCTGTTCAGGGACCTTGCCA ATTTCTTCATC | 0.001689593 | 0.009272144 | 3.88E-06 |
| 273 | 3428610 | 9 | MYBPC1 | AGAGAAGGAGGCCGGAACTACACCAGC AAAAG | 0.000102061 | 0.019860486 | 1.97E-05 |
| 121 | 3428624 | 9 | MYBPC1 | CATTTGAGATGCAGATCATCAAGGCCAA AGATAACTTTGCAGGAAATTACAGATGC GAGGTCACCTATAAGGATAAGTTTGACA GCTG | 0.000138152 | 0.025277716 | 2.87E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 50 | 3428626 | 9 | MYBPC1 | AGGATGCAGGAGAACTTGACTTTAGTGGTCT | 2.14E-07 | 0.070836699 | 9.91E-05 |
| 421 | 3428630 | 9 | MYBPC1 | CAGTGAGTACGAGAAGATCGCCTTCCAGTATGGAATCACCGACCTGCGCGGCATGCTCAAGCGACTCAAGCGCATGCGCAGA | 5.22E-05 | 0.012819523 | 8.90E-06 |
| 509 | 3428631 | 9 | MYBPC1 | CTTGATCCTGCATATCAGGTTGACAAAGGAGGCAGAGTGAGGTTTGTTGTGGAGCTGGCAGATCCAAAGTTGGAGGTGAAATGGTATAAAAATGGTCAAGAAATTCGACCCAGTACCAA | 0.001171064 | 0.014030378 | 9.24E-06 |
| 1901 | 3428639 | 9 | MYBPC1 | AGGAAACAAGCTTCGTCTTGAGATCCCCATCAGCGGAGAACCACCTCCTAAAGCCATGTGGAGCCGGGGA | 4.76E-05 | 0.007216313 | 4.05E-06 |
| 1440 | 3428640 | 9 | MYBPC1 | GGCAGTGGCCGGATAAGAACAGAATCTTACCCTGATAGCAGCACTCTGGTCATTGATATAGCTGAAAGAGATGACTCTGGTGTTTACCACATCAATCTGAAAAACGAAGCTGGAGAGGCACATGCAAGCATCAAGGTTA | 0.011488537 | 0.007374662 | 2.66E-06 |
| 100 | 3428641 | 9 | MYBPC1 | CTGATCCTCCAGTGGCACCGACTGTGACAGAGGTGGGAGATGACTGGTGTATCATGAACTGGGAGCCTCCTGCCTACGACGGAGGCTCTCCAATCCTAG | 7.61E-05 | 0.029360211 | 3.68E-05 |
| 498 | 3428643 | 9 | MYBPC1 | CCTCCTACTCTTCTGACTGTGGACTCTGTCACTGACACGACTGTCACGATGAGGTGGCGCCCCCCAGACCACATTGGTGCAGCAGGTTTAGATGGCTATGTGCTAGAGTATTGCTTTGA | 0.000547163 | 0.014490122 | 1.22E-05 |
| 1495 | 3428647 | 9 | MYBPC1 | TGCGTGTGAAGGCTGTTAATGCAGCTGGTGCCAGCGAGCCCAAGTACTATTCTCAGCCCATTCTCGTGAAGGAAATCATAG | 0.005280805 | 0.008215244 | 3.64E-06 |
| 459 | 3428651 | 9 | MYBPC1 | CCAAATTGTGAAGATTGAGGATGTCTGGGGAGAAAATGTCGCTCTCACATGGACTCCACCAAAGGATGATGGAAATGCTGCTATCACAGGCTATACCATTCA | 0.000664925 | 0.015153353 | 1.32E-05 |
| 355 | 3428655 | 9 | MYBPC1 | TCAGAGGCACCCATGTTTACTCAGCCTTTGGTTAACACCTATGCCATAGCTGGTTACAATGCCACCCTAAACTGCAGTGTG | 0.000579253 | 0.015754106 | 1.72E-05 |
| 202 | 3428665 | 9 | MYBPC1 | AGACTCCTCTTGCAAGGCGTACCTCCAAACATAATTGATTCGTATCTGCGAGACTTACACTCAAGCAATC | 0.003339377 | 0.020953424 | 2.12E-05 |
| 970 | 3429167 | 9 | STAB2 | CTTCTTACAATTAGGACCGAGTGCCGATCCTGCGCTCTCAACCTTGGAGTCAAGTGCCCGGATGGTTACACCATGA | 0.045322973 | 0.007449469 | 6.24E-06 |
| 1104 | 3430743 | 2 | FICD | TCAGCCGCCTGTGGACATGCGCAAAGGGCCCTCTCCTGAGT | 0.00551979 | 0.008200033 | 5.38E-06 |
| 1313 | 3431048 | 9 | ACACB | CCAGCGAGTGATCCAGGTGGAGAATTCCCACATCATCCTCACAGGAGCAAGTGCTCTCAA | 0.001298982 | 0.006971522 | 3.36E-06 |
| 1840 | 3431135 | 6 | | TGCCCAATACACGATTTTGACATTCAGTCATGATTGTTTTAAAGTTTTATTGTAGACTTTGCTGTTGGATACAAAATGAAGGCATACAACTGTCACAGGCAGGGCAGTAAGTACAAAGTCTAAGCTGTAAAAACCGTTTGAAAATATAAACTCGTTTTTGGAATACATGTGTCAAAGGCTGCCCATGTTAATACCTTTGGTATAAAACGGTAACGATTCCCTTGACAAACCCATCCATCACCTGACGCACATTCACATCTCCTGGTAACTACTCTACCTAGTCTAGTCTCAACCACCCCTGTCAGTCACGACTCACTCCTGTTC | 0.00023941 | 0.010844051 | 5.73E-06 |
| 224 | 3432191 | 5 | TMEM116 | TGTCTGGGTATCTGCATCACGCCGAGCCTCCTGCTTTAGTTGGTGGAATTTGTGCTGCGTCCAGCCATATACTCCACAGTTGAGTAGACCCTGAGATGTTGCCGTTAGAGCC | 0.003302969 | 0.016329795 | 1.27E-05 |
| 899 | 3433246 | 1 | | AGGCAGCAGATACTCGGGTGCTAAAAATCCCTCCAAACATCTCAACATTTTTTCCCCCTCGGGATCAGTATGGTGTCACG | 0.01286993 | 0.008994596 | 7.50E-06 |
| 627 | 3433531 | 1 | | TGGCTAAGTCACGAATAGGCATTCACCATATGTACATGATAAATGGCCAATCAAAATAAGGAATGGGGCTCATTCTGCTGAA | 0.000170561 | 0.015569748 | 1.05E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ATTAAATACATTCAAACAAGAACAGAGA<br>TCCATTAGCAAAATGTTTAAAAATAATA<br>TCACAGGGTTACCAGGGGTATGACAAAA<br>ATGGACACTTCCATACACACTAGGTGAA<br>TATATTGGTGAAAATAGTTCAGATAAAC<br>ATACAACCATGTATGTAAAAGTATTTAT<br>CATCAATGCATTATTTGTAGTAGCAAAA<br>ACAACAAGCAGCCTTGGAAACCAGTTAA<br>TGTCCTCAGCAGGGAATTAATAATATTA<br>TTGTATATTCATGAAATTGACACCATGTG<br>GCCACACAAATGCATTACACAGGCCTCT<br>ATGTAACATAGGATATTCATTAGAGAAT<br>TGTTTTTCAAGAGGACAAAGTACTTTCAT<br>TTTTGCCTAGAAAATGGGGAAGACAAA<br>AATGCGCTTCTCTCTAGGTTGTGTGATTT<br>TAGGTTATCCTAAGTTTCATCCTTACGTG<br>CTCCTGA | | | |
| 1825 | 3435731 | 8 | PITPNM2 | AGGAGAAGGAAAGATCTCGTTCTTAGCG<br>AACCCCAGGGAGTGTGGCCTCCCTCCAC<br>CCCATGACTCTCGCTACCAGGGCCCGGT<br>GGTCACTATGCCACAAA | 0.001877871 | 0.007175536 | 7.03E-06 |
| 1654 | 3436139 | 9 | DNAH10 | CTTGGGCTGACGACAAAGTTGTACATCC<br>TGAACCCCAAAGCCGTGAGTGTCATAGA<br>ACTCTACGGCATCCTGGACCCAACCACC<br>CGAGACTGGACAGATG | 0.009627872 | 0.006840034 | 6.70E-06 |
| 271 | 3439162 | 2 | P2RX2 | CTGCTCCCGGTCTTGGGCCCTGGGAACC<br>CCACCCCACCCCACCCCACAGGCGTTGT<br>AACCTTGAATCTGCCCAGACTCTT | 0.000425014 | 0.015078838 | 9.02E-06 |
| 334 | 3439330 | 1 | | CTGCTGATGATCAGTGTCAATGCCCCAG<br>CAAAGAGTGGCTTTTCTGGCATGCTGGT<br>CCTTGGACACAAGGGTACAAAGTTCCAT<br>GCTGTATCTGTAGTTTATAATTTAGAACA<br>CTCTGTCCTC | 0.001332936 | 0.008574024 | 3.79E-06 |
| 1199 | 3440108 | 4 | CACNA2D4 | CACAACGACAGCACAAGGCTCTTGGCTG | 0.000318921 | 0.007172134 | 3.04E-06 |
| 1555 | 3440184 | 3 | RP5-<br>1096D14.2 | ACGTGTCATCCGTCAGTGCTCCATGCAG<br>TGCTCCACCACGGCATCCGCCACTCTG<br>CACCAGCTCCGCGGGGATGGACGCACAG<br>GCCCCAGTCATGGCCCTGCCCTGAGGAG<br>ATGCTGGTCGTCTTCCTGCTCATTCACTC<br>CCCTGTGCTGCACTGCTGGGGTCAGACA<br>AGGCTCCATCCAAGAACCCATGACTTCA<br>AAAGAAAGAAACCTTTGTCCTCAAATTT<br>GGTAACAGGCAAACGGTCTGCGTGGAAG<br>CCCTGTCTGCAGCCTCTGCTCACTCCAGG<br>ACGTGCTGCCCTCACTGCTCCTCTGATGT<br>GCCCCCGGCTCAAGGCTGAGCATTCCCG<br>TATCCACGCAGGAAGGCCGGGGACTGG<br>CTCCCAAACAGCGGCCAGGACCTTGGGG<br>GCACCCAGGGAGACTGGGGCCCTGCACC<br>TCAGGGCTTTGGATCCAGGTCTGGGACG<br>AGCCCTGGGAATCAGCATGGGAGCAGTG<br>GCAGCCATCCTGTGGCCCTGAGGGGAGC<br>TGGCTGGAGGACAACCTGAAATGCTGAG<br>GGCAGCAGGAGGAAACACAGAAGGAAC<br>CTGCGTCCTGGGTGACATCCCGGACCTG<br>CTGCACTCGCCGGCCCTGGAGCCACCTG<br>CCTCTGGCTTCATGTGAGCTGTCACACTG<br>TTATTATTATTTCGTTCCTCAAGTAGGGG<br>TTTCCTGCTCCTTGCAGCCGGAAGCAGT<br>AAGTGGTAGCCACCCCACCCCTGCAGGG<br>CAGTCTTCTGATGGCTCTGAGCTCCCTGA<br>GGTGGGGGCGAGGCAGGGTCTGTGCTCC<br>ACTCTGAGGGCCCAGTGGAGCAGCAGGT<br>GTTCGAACACATAGGGTTTACCCCAGGC<br>AGAAACCACCCTCATAAGGGCATGAGAC<br>CCAGGCAGAGTGAGCTCTCTGGCCTCTT<br>GGTATTTCTTTTGTGTCTGTCTTCTCAG<br>CAGCCTATGAGCTCCTCCAGGGCAAAAA<br>ACTGCCATCATGCTAAGGGGTTCTGGAC<br>CCTGGGGCCAGGCACAGGGCAGGGAC | 0.012305161 | 0.008586488 | 8.01E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | AGAGTGGGCAGGTAACGAAGGCTTGCTG GGCACCGTGGGAGAGAAGGGAACGGAG GCATTGAGGGGCAAGAGAAAAGGAGAA GTGGAAGGCCAGACAGGCAGAGAAGGA AAGGTTCGTGGAGAGCAGTCTCTTCATG GGGACCCAAGGAGGCCCCACCAGAGAG GAACTGAGGCTGTGAAATGGAAGGATG GAGGCCTGAGGGATCCAGGCCAGTGGAC AAGTGAGCCCGAGCAGACGGAACCATCC CCATGCCTATCTGGTTGTCTCCTCCTCCT CCTGCTCCTCACCCCCTTCCTCCTCCTCC ACCTCCTCCTTCTCCCCCTCCTCCTCCTTC TCCCCCTCTTCCTCCTCGCCCTCTCCCTC CCCCTCTTCTTCCTCCTCCTCCCTCTCTTC CTCCTCCTCCCCCTCTTCCTCCCCCTCTTC ATCCCACTCTTCCTCCTCCCCTCTTCCTC CCCCTCTTCCTCCTCCTCCCCCTCTTACTC CTCCCCTTCTTCTTCCCCCTCTTCCTCCTC CCCTCTTCCTCCTCCTCCTCCTCCCCCCTTC CTTCTCCTCCTCTTCTTCCTCCTCCTTCCC CTTCCTCCTCCTCCTCCCCCTCTTCTTCCT CCTTCTCCTATCCTCTTTTTCTTCCTCAAC CTTTTCCTCCTCCTCCTCCTCCTCCTTCCC CGCCTTACCCCTCCTTCCCCACACTCTGA AATGAGCACATGGCTCAGACTGAGAGGA CAAACCTCCAGCTGAATTTAGTTGTAGC TGTGGTTCCCCAAAATGCTTTGAGGATTC ATCAGAACCAGTAGCTGCCTCTCTGCTTC CTCATCTACACACCTAATTTTGTAGCTTC AGAACAGGTGTGACTCAGGCAGAGGAA GGGCTACACAGGTGTCACTGTGCCCACC CCTAGGGAGACTGCTACAGACAGACTTC CCGGTGGGACCCGGCCCCCACCCATGCA TGGTGGCCACGGGCATGAGGAGGGTGAT AATGACAAGGGGAGCCACGATGACCAC AGGGTTTATAGAGATCTCGCCATTTGCT GAGCAATGTGGAGGAACGTTACACACAC CATGTCGCCTCCCCCGATGCCTGCAGGG CAGGTATCATTGCCCTGCATTCTATTGAG GAGGAAATTGAGTTGGAAGTGCCCAAGA TCACGTCGTTA | | | |
| 81 | 3440944 | 6 | | GCGTGCCTGGGCATTTAACAAAGGCAAG AAGGAAAAAAAGGAGAAAATTGGGGAT TGAGAAAATTGAATTAAAGAAGAAAAG ATTGATCAGATTATTTGAAGAGAAACCT CATCACATCCCACCGTTGTTTGCCCCCTT CCCGACCCTGTGCTCTCTCTTCCGATTCA GATTCAAAAGCATTAACTGGGCACCTAC TTAAGCTAGACTGTATGCCAAGCTCCTC GCATACAATTTCCTACACTTTTAAAGTTG CAGGCTTTGTAACTGCTCTTAGCAGAGG CAGGTTCTGCTTTAGAAAGTTTGCATACC ATCATTTTTCTCTTGGTTCTTAATCAGCG AATC | 0.00180613 | 0.026417303 | 3.09E-05 |
| 1169 | 3442059 | 9 | CHD4 | CAAGCTCTGGTGATTGAGGAACAGCTGC GCCGGGCTGCTTACTTGAACATGTCAGA AGACCCTTCTCACCCTTCCATGGCCCTCA ACACCCGCTTTGCTGAGGTGGAGTGTTT GGCGGAAAGTCATCAGCACCTGTCCAAG GAGTCAATGGCAGGAAACAAGCCAGCC AATGCAGTCCTGCACAA | 0.000570716 | 0.009351255 | 8.12E-06 |
| 1114 | 3448127 | 8 | SSPN | ACCAACCCACGGTCTCTGGAGCACCTGT GGAATTCGACTGGACTGGCTCCAGCTTT TACAGTCTCTCTGA | 0.011131791 | 0.007354431 | 5.34E-06 |
| 379 | 3448205 | 4 | ITPR2 | CCCTTCTCATTAGGACCTGGCTGTGGATA AAAATTTCTCCCCAGGTCCATCCCATCTT ATGCAGTGACAATGACCTGTAATGCTAT CCTGACACCAACTGGTAACATACTGCAG TATAATTCCCGGGCTAACCACCCAGAGT | 0.003147077 | 0.013261635 | 1.12E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 107 | 3449806 | 9 | DENND5B | CAGCACAGACCACACAAGTTCCAGGGCATAGTCCTCAAA GTTTGCAGATTACGAAGCATTTGTCATTCAGACTGCCCAGGACATGGAATCCTGGCTGACCAACCGGGAACAGA | 0.001925692 | 0.017715275 | 1.68E-05 |
| 626 | 3452385 | 1 | | GTCACATGTGCTAGATAGTTCTCCACAGAGAAGACCTTGGTCTTCAGGATGTCAGGCAAACCTCCTGACTCAAGCACTGAAATAAACACAAATCACCATTATGAAGTCAAATCTATAAACAAGCTTGGAAACCAATCCAAAATCCCTCAGATCCACACCTATACACTCAGTGACTCATGTCTATGAGCCATGGTGACCATGCCCAGGGTTGGGGTCAGAAGAATCAGGGGAAGTGCAATAGCAAGGGGACTCTTCCACAGCCTTTTTTGAGGGTTCTTCAGTCCTGGCTAACTCTGCATTCCATTTATGATGCCTATGAGGAATACAAGAGGAGCTTCAAATAAGCACTGGGTATATGAGCCTGGAGCTCACCGAAGTCAGA | 9.00E-05 | 0.009592315 | 3.89E-06 |
| 1819 | 3452862 | 7 | TMEM106C | CTGGGCACAGGCTAGGCACTGATTCTGCTGGTTCTGAGAAACATAAATGGTACCATAGGGAGGTGTTTCCTCCTAAGTGGCAGGAGGATGTTTGCTGGGAGTTAAGTGAACCAATTCCTCCTCTGCTTACACCACGTGGGGGTAGGTCCAGAACTCAGGCCTTGGGAACATATGCTGTGCTCTCTTCTACAGGCGCTGTG | 0.000319739 | 0.008530675 | 3.81E-06 |
| 993 | 3453875 | 6 | | CAATTTACGGCAATAGACATTTACAGAACAAAAATAAGACAGTTCCAAGACAAAGGAGTGTAAAAGTACAGCACACAGGTTAATACTCTTCACCCTCATCCTCTCCGTCAGCACTATCTGCTCCAACCTCCTCATAATCCTTCTCAAGGGCAGCCATGTCCTCACGGGCCTCTGAAAACTCGCCTTCCTCCATCCCCTCACCCACGTACCAGTGAACAAAGGCACGCTTGGCATACATCAGGTCAAACTTGTGGTCCAGGCGAGCCCAGGCCTCGGCAACAGCTGTGGTATTGCTC | 1.50E-05 | 0.017942905 | 1.38E-05 |
| 2014 | 3454060 | 4 | FMNL3 | TCTCTCTGGGGTACAATGGAGTAGAAAACTTAGGGACAGAAGGAATATACGAATAGAGAAATTCGATTTGCCCAATCTTTATTGCTCACCTATTAAAGTGCTAAACAAGCTGATGGTGATTCCTGTTCTCAGAAGCCTGTGTTCTAGCAGGTTATAAGAAGATGAGTCTGGTTAAAGAGAAGAGCAGGGAAGTGGCTTAGATTATGGCATAAACTGAAGTTGAAACTCAGAATGAAAAGTAGGAGTTTGCTGAGGGGAAAGCAATATATAAAGTGATTTGTGCTATAGGACATAAGACAGATTATAGATAAGAGAACTCAGAAATAGTAAGGACAGTGGTAAAAAGTTAAAGGATCCTCCCTTTCCCCAGTTAACCAGGAGACCAAATAAGGGACTTGGTGGTAGGAGTGGTAGGAGCAGGATCAATCACTTATTTATTAAGCACCTGCACATGATTCAAAGA | 0.000984436 | 0.006743349 | 4.61E-06 |
| 1908 | 3454236 | 9 | RACGAP1 | ATCTCTGGCTGTGACCGCACAGTAAAAGAGCTG | 0.000165652 | 0.008552193 | 5.05E-06 |
| 1892 | 3454247 | 9 | RACGAP1 | TTGAGGATTTCCGTAAAAAGTGGCAGAGGACTGACCATGAGCTGGGGAAATACAAGGATCTTTTGATGAAAGCAGAGACTGAGCGAAGTGCTCTGGATGTTAAGCTGAAGCATGCACGTAATCAGGTGGATGTAGAGATCAAACGGAGACAGAGA | 0.007337714 | 0.008243299 | 4.88E-06 |
| 1591 | 3454249 | 9 | RACGAP1 | TTGTGCGCCGGGTGGAGATTCTCAGTGAAGGAAAT | 0.004304377 | 0.011117041 | 8.17E-06 |
| 1689 | 3454251 | 4 | RACGAP1 | GGTGACAACCTGCAAGTGATAAGGGGGTGGGTATGGTAGATACATGAGAGAAGAGTACACAAGGTTTAGTGATTATGCTGTGGGAAGGGGAGGAACCAGAGGTGATTCTGAAGTTTGGAACTGAGCGACTGAGAGAATG | 0.00076237 | 0.010799497 | 7.64E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1797 | 3454663 | 2 | CSRNP2 | ATAAAAATAGGGAAATCAAAATTGGAA GTCAGTAGGGTATGGGATAGGGTAGGTC AGTGAGTAGCGTAGTTGATGGACA CCATCACGTATGTCGCAGCAGCATTTCA CCCCTGAAGTCTCTAAACTCTGAGCCTG AAAAGATTTGTATTTAATACACATAACA TTTTTTAGTTCATTCTGCCTTTCCTATTTG TTCCAGTTTTTGCTTGGTTTTAGTTTGGA GGGGAACTTAAGTACACAGATCCTTATC TCTCCCCATCCCCTAGCCTCACAAAACA CAGTTGAGAGTCTTTTAAGTACCTGAGC TCTCGAAGCTACCCAGAACTGAACTAGA CTCCCCTACCTTAGACTGGTACCCTCAAA CACAGGACTGAAGCTTAATTGGGAATTT GGCTTTATGGAGAAAAGAATCTTTTTCA AAGTTTGTGTCGGAAGGGAGGGTGAGG TTTGCCCACTGTCTCTGCAGGAAGGCTCC GGCTTAATCTAGGAAGTAGATTCCAGCT GCACGATGAGGAACACATTAGCTTTTGG GATCAAACCAGGAATATGAATCTGTAAT TATTAAGCTCATTGCCAACCCACAAGAT ATGTTTCTGAAAACCTGTAGTTTCTTAAT TTAAGTCCATCCCCTTCATTAACGCTACA GTTGTGACTCACACTGATCCCAAACTTTT AAGTGCTAAATATTAACATTTAGCATTA ACTGTCTTGTCAAGCGAAAGGCCTTCTCT ACAACCTAGTCCATCTCACTTCTGGTGCT ACCTGAGTTGGACAGAATTCTAGCTCAT GGTTGCTAGGAAAGCTAGGCCTCTGATC ATAGAAGCAGATAGCTTCAGTCCCAGTC TAGGCCTAGA | 0.026058101 | 0.006874234 | 7.89E-06 |
| 377 | 3455102 | 5 | NR4A1 | GCTCTGCTGGCACTTCACAAAAGCGCAT TCACATGTTGGCCATTAGTAAGCATCGT CACAAGTCTGAGAAGCAGTAACCCTCAT TATCCTCATACTCCAAGTG | 0.000708617 | 0.013562634 | 1.16E-05 |
| 994 | 3455119 | 1 | | AAATTCTGGGGCTACATTTCCATCCTGTA TGAAACTATTGAACATCCTTGGTCAACA CTCTCTGTAGAGATTTGTTTTA | 0.034019558 | 0.007187542 | 3.36E-06 |
| 1468 | 3455129 | 1 | | TATTGATGAAGGTGTCACAACGGCAAGA T | 0.024191116 | 0.006911722 | 5.22E-06 |
| 389 | 3455389 | 1 | | TAGCATCATCATTGAAGTCAAGGCCCAG CATGAAGACATCGCCAACAACAGCAGG | 0.014179003 | 0.010346618 | 6.20E-06 |
| 1436 | 3456343 | 1 | | CTGCCGCCCGCCTGCAAGATGGATTGGC CGCATTGAAATTCCTCCGCGAG | 0.013379902 | 0.008092246 | 3.37E-06 |
| 1977 | 3457204 | 2 | SARNP | GTCACATATATGCCTAAATGCACAGTCA TGTGCCTACGTCCTGCCTCGCAATGAGG GAGCATGTA | 0.00011347 | 0.007559171 | 2.29E-06 |
| 924 | 3457859 | 9 | TIMELESS | TCGATTTGGGGGCTCCTATATTGTCCAGG GGTTGAAATCCATTGGGGAGAGGGACCT CATCTTTCACAAAGGCCTTCAC | 7.10E-06 | 0.011459793 | 8.55E-06 |
| 1048 | 3461394 | 4 | CPM | TTCAGTATCTTTGGCCTTACAGAAGTTTT TAATTTTTATGAGATCGTATTCGTCAGTC CTTTTCTTTATGCTTTTATGTTCCATGCCT CACTTAAAAAGGCCCTCTTTCCCCCAAG GTCATAAATATATTCTATACCCTTTTCAA TATTTTTATGGTTTTAGTTTTTATGTTTAG CACCTAACTCCATCTGGAATCTATTTTTG GGAATCGAGTGGTATGTAGATAGATTTC ATGTCTGACAATATATATTTTTGAGCACT CAAATTTTTAAAAAGTATGTATGACTTTG GTAAGCAGAAAGAGCCAAGAGGAGTTT GAAGAGACACTCAGAAAGTGGATGTCCA TTCTGGGTGGGCCCAGGAGTTTGCAATT TTAGC | 0.000172838 | 0.008653889 | 5.97E-06 |
| 1453 | 3462104 | 2 | ZFC3H1 | CCTCAAAGTGACTGACATTTATTTTAATT TTGCTTTGTTTTTTTTATTTTCTCCCCCA TTCCTTTATTTTGTGTTATTCCTGACTCAC TTGACACTCTCTGATGCCTGAGAGATTCC TGTTTGGGATTTAATATCCAGGGCTGTGT TTAC | 0.002887295 | 0.008108262 | 5.31E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 2025 | 3462988 | 9 | OSBPL8 | CTGAATCTAAACTTTATAATGGCTCAGAGAAGGACAGTTCAACTTCAAGCAAACTCAC | 0.000563692 | 0.006950222 | 6.46E-06 |
| 2040 | 3462998 | 9 | OSBPL8 | AAGAAGCTTATCCAACGCCAACCAAAGATTTGCATCAGCCATCTCTTAGTCCAGCAAGTCCT | 0.015311147 | 0.007361228 | 4.24E-06 |
| 749 | 3465245 | 1 | | CAATAATGTTGGGAGATGGGACCTAATAAGAGGTGATTTGGTCATGGTCATGAGGGCTCTGCCCAAATAAATGAATTAATTTCATTATTGGAAGAAATAGTTTTGTTATAAAATGAATTTGGCTTATTTTGCACATGTGCATGTGTTCTCCTACCCTTCCAACATGAGATGACACAGCAAGAAGGCCCTCACCAGATGTGAGCGCCTTGACTTT | 0.000552621 | 0.006681797 | 3.72E-06 |
| 589 | 3468064 | 5 | MYBPC1 | ATGGTGTGTCAAACCATTTGGAACAATTTTTTCATTGCTTAGTGATTTATAAAGTGCTGGTGTATCTTAATAGCAGTGGTGTCTTAGACTTGCAGAAATACAGTACATCATAAATAATACATTAAAGTAGGTCTGCCTCTTACAATGTGTATACCTTCAGACTTCTACCAAATCATATGTGCAGTCTTAGAGGTTTCTAGGTA | 0.000873066 | 0.012604826 | 6.35E-06 |
| 192 | 3468071 | 5 | MYBPC1 | TCTGTTCTTATCCGGCCACTGCCTTCCATAATAGCCTAAGAAGTGG | 4.98E-05 | 0.018785189 | 1.97E-05 |
| 419 | 3468104 | 2 | GNPTAB | TCACGTGCAGGTCTAATTTCAAAGGGCTAGAGTTAGTACTACTTACCAGATGTAATTATGTTTTGGAAATGTACATATTCAAACAGAAGTGCCTCATTTTAGAAATGAGTAGTGCTGATGGCACTGGCACATTACAGTGGTGTCTTGTTTAATACTCATTGGTATATTCCAGTAGCTATCTCTCTCAGTTGGTTTTTGATAGAACAGAGGCCAGCAAACTTTCTTTGTAAAAGGCTGGTTAGTAAATTATTGCAGGCCACCTGTGTCTTTGTCATACATTCTTCTTGCTGTTGTTTAGTTTGTTTTTTTTCAAACAACCCTCTAAAAATGTAAAAACCATGTTTAGCTTGCAGCTGTACAAAAACTGCCCACCAGCCAGATGTGACCCTCAGGCCATCATTTGCCAATCACTGAGAATTAGTTTTTGTTGTTGTTGTTGTTGTTTTTGAGACAGAGTCTCTCTCTGTTGCCCAGGCTGGAGTGCAGTGGCGCAATCTCAGCTCACTGCAACCTCCGCCTCCCGGGTTCAAGCAGTTCTGTCTCAGCCTTCTGAGTAGCTGGGACTACAGGTGCATGCCACCACACCCTGCTAATTTTTTGTATTTTTAGTAGAGACGGGGGTTCCACCATATTGGTCAGGCTTATCTTGAACTCCTGACCTCAGGTGATCCACCTGCCTCTGCCTCCCAAAGTGCTGAGATTACAGGCATAAGCCAGTGCACCCAGCCGAGAATTAGTATT | 0.000655208 | 0.015552323 | 1.51E-05 |
| 1936 | 3468105 | 9 | GNPTAB | TGCACTTAAGCGGAAGATATTTCCCAGAAGGAGGATACACAAAGAAGCTAGTCCCAATCGAATCAGAGTATAG | 1.12E-05 | 0.007894032 | 6.49E-06 |
| 1843 | 3468121 | 9 | GNPTAB | CACAAAGTGCGCCATTCTGAGGATATGCAGTTTGCCTTCTCTTATTTTTATTATCTCATGAGTGCAGTGCCACTGAATATATCTCAAGTCTTTGATGAAGTTGATACAGATCAATCTGGTGTCTTGTCTGACAGAGAAATCCGAACACTGGCTACCAGAATTCACGAACTGC | 9.90E-05 | 0.010165009 | 7.09E-06 |
| 618 | 3468122 | 9 | GNPTAB | TTTGGATTCACATCGCGGAAAGTCCCTGCTCACATGCCTCACATGATTGACCGGATTGTTATGCAAGA | 6.95E-06 | 0.011918652 | 7.85E-06 |
| 1921 | 3468125 | 9 | GNPTAB | CAAATGCAGTTTGGTGGCTCCACAGGAAAAACAGGTTCATAAAAGCATCTTGCCAAACAGCTTAGGAGTGTCTGAAAGATTGCAGAGGTTGACTTTTCCTGCAGTGAGTGTAAAAGTGAATGGTCATGACCAGGGTCAGAATCCACCCCTGGACTTGGAGACCACAG | 0.00020953 | 0.007617622 | 6.03E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 579 | 3468126 | 9 | GNPTAB | CAAGATTTAGAGTGGAAACTCACACCCA AAAAACCATAGGCGGAAATGTGACAAA AGAAAAGCCCCCATCTCTGATTGTTCCA CTGGAAAGCCAGATGACAAAAGAAAAG AAAATCACAGGGAAAGAAAAAGAGAAC AGTAGAATGGAGGAAAATGCTGAAAAT CACATAGGCGTTACTG TGAAGGTGCCTATAGTGACAATCCAATA ATTCGACATGCTTCTATTGCCAACAAGT GGAAAACCATCCACCTCATAATGCACAG TGGAATGAATGCCACCACAATACATTTT AATCTCACGTTTCAAAATACAAACGATG AAGAGTTCAAAATGCAGATAACAGTGGA GGTGGACACAAGGGAGGGACCAAAACT GAATTCTACAGCCCAGAAGGGTTACGAA AATTTAGTTAGTCCCATAACACTTCTTCC AGAGGCGGAAATCCTTTTTGAGGATATT CCCAAAGAAAACGCTTCCCGAAGTTTA AGAGACATGATGTTAACTCAACAAGGAG AGCCCAGGAAGAGGTGAAAATTCCCTG GTAAATATTTCACTCCTTCCAAAAGACG CCCAGTTGAG | 3.85E-06 | 0.014435127 | 1.06E-05 |
| 1015 | 3469401 | 1 |  | GCCATCCACATGGCCAATTCAACCTGCT | 0.003557945 | 0.008173686 | 6.81E-06 |
| 1076 | 3469805 | 5 | RIC8B | TGCATTCTTGTTTCCCACTTGCAGATCTC CCAAGAGTCCCTTCGAATTTACCTATAC GAGTTTCAGCTTCCCGCTTGCCACTTAGC TTGATAACGACTCAAAAATCATTCCCTT GTTTTCAAGGGCTCTTCTTTCTTGTCTGC TCTGTGTACTACAGGGC | 0.025498894 | 0.009095378 | 6.52E-06 |
| 73 | 3470260 | 4 | SART3 | CCTGTGACCAGCAGCATACGGGCTTTGG GGT | 0.01575619 | 0.021496487 | 3.64E-05 |
| 189 | 3470958 | 4 | TRPV4 | CCCGGCAAGACTGATTTGGAATGGCAGG CACTCACAGTTGTGTTTATTTGAGGGTAC CACAGGAAGTGGGGGCCCCCAAATTGGC TAAGGAGCCCCAGGGTGGAGGGAGGTA GAAGCACACTGGGTCTGTCTGGGAGCCT GAGCACCTTCTCTGTGGGCTCCTTCCTAC CCATGGATTCCAACCCCCACCCACCTCC CCACTGCCCACCCACTCACCCATCTCTTC TGCTTTCCTTCTCCCTGTGCCCCAGGCCA CACCATTCCTCTGTGCACCCTGCACTTTC CCCTCTACACCTTTGTCCTTGACACCTCC TCTGCCCTTTATCTTCCTCCTCCTCCTCCT CACAGCCTTTCCCCCTCCCCATCAGGATT CTGGCTGCCCTTGCTCTGCAACCCTGCCT GGAACTTCAGGTCCCTGATCTTACAGCC TA | 3.23E-05 | 0.013118108 | 8.19E-06 |
| 543 | 3471602 | 4 | ATXN2 | GTGAACACATCCTACTCTGCTTCTGATTC TCAACTTACTGTTTTTGAAGCACATGAAC AGGCCAGGCACGGTGGCTCACGTCTGTA ATCCCAGCACTTTGGGAGGCTGAAGTGG GCGGATCATTTGAGGTCAGGAGTTTGAG ATCAGCCTGGCCAGCATGGCGAAACCCC ATCTCTACTAAAAATACAAAAATTAGCT GGGCGTGGTGGCACATGCCTGTAATCTC AGCTACTCGGGAGGCTGAGGCAGGAGA ATTGCTTGAACCTGGGAGGCAGAGGTTG CAGTGAGCCTGGGCAACAGAGTGAGTGA GACTTATATCTCAAAAAAAAACAAAAAA CAAAAAACTGAAAGACATGAAGAAATG GTTTTTGTACCAAGGTTTGGCCCACGCTG AGATTCACAAAGAACTGGCTTTCAGTTC TTATCTTTATTTTGATTTAAACTGGCCCA TCATGTTGTCCTTTG | 0.001339198 | 0.012656175 | 7.58E-06 |
| 1136 | 3471633 | 9 | ATXN2 | AGATTCCAGGCTTCAAGATCAGAGGCAG AACTCTCCTGCAGGGAATAAAGAAAATA TTAAACCCAATGAAACATCACCTAGCTT CTCAAAAGCTG | 0.004061321 | 0.008273273 | 6.75E-06 |
| 1028 | 3471764 | 5 | MAPKAPK5 | GAGTCAGCTGGACGTGGTAGATCATGCC | 0.001705241 | 0.007376753 | 3.38E-06 |
| 687 | 3472790 | 4 | TBX3 | GAACATGAATCCAACCAAGGGTCCCCCT | 0.002880903 | 0.008033958 | 6.27E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 556 | 3473370 | 5 | RNFT2 | TTCCACCTCTGAGTAACTCTGTGTATATA ACTTCTTCTTCCCACCAAGGGGAAGGGA TTTGAAAGATTACACACTATAGCATTTTT CTCAAAGTGCAAAATGCATGTGCCCTCT AGACCCAGAATCCTGTGAAATGAAGTTG TTAATGTAATAATAAAATGTAGCATTTTT GATCAGACAAAAAGGCCATGGGCCTTCT CCACCTAATGGCCATGGCAGAGCATATA AATGAAAACAGATGTTTCCAGTGGTCAT TCAGTACTGTAACTGTCAATATTG TGTTGACAGTGGACGATACACCCTCCCT TCTCTCTCCGACAGGGTCGCCATCAAAC CCAGTTGAAGAGGGTCCAGTGAGAGCCT ATTAGAGGCTTCACAACTCACTTGCCAG CAGCAGATTTCTCCCATCGCTTAGAGAC TGCTCACTCACACCACTCCTCAGAAGAC CTCCAGCAACATACACAGCCAGGAACGA CAGGAAGGAAGGGACATGACATTTACTG AACGGCAGTGCTGAACCAGGCACTGAGC CAGGGCCTGTTACTAAGGGCAAAGC | 2.29E-06 | 0.012094303 | 1.14E-05 |
| 1518 | 3473458 | 9 | TESC | TCTCATCGGATCAGATCGAGCAGCTCCA TCGGAGATTTAAGCAGCTGAGTGGAGAT CAGCCTACCATTC | 4.91E-05 | 0.007870352 | 2.49E-06 |
| 47 | 3473622 | 9 | KSR2 | GACAGAGTCCGTTCCGTGTGACATCAAC AACCCTCTACGGAAGCCACCTCGCTATT CAGACCTGCACATCAGTCAGACGCTC | 4.80E-07 | 0.065638753 | 8.65E-05 |
| 311 | 3473690 | 9 | KSR2 | CAAAAAGCCTTACAGCAGTGCGAACTGG TCCAAAACATGATAGACTTGAGCATCTC CAACCTGGAAGGGCTTAGGACCAAATGT GCTACC | 0.000664925 | 0.013784107 | 1.32E-05 |
| 557 | 3473708 | 1 | | AGGGGCTCCCCCCAGACAGTGTCAGGAG ACCTGATGGGTGAAGGAGGGATCAGTCG GCACAGTTGA | 0.046404092 | 0.008792034 | 8.42E-06 |
| 452 | 3474192 | 9 | CIT | GAAGAGCGGAACATATTATCTCGAAGCA CAAGCCCGTGGATCCCCCAATTACAGTA TGCCTTTCAGGACAAAAATC | 0.001852254 | 0.018785154 | 1.33E-05 |
| 1441 | 3474713 | 3 | AC069214.1 | CCAACTCCCTCTGTTAAAGGCATCTCTCC AACTCGGC | 0.002217036 | 0.008112305 | 5.71E-06 |
| 364 | 3474739 | 4 | AC069214.1 | TGACTCCAGAGACGTTCCCATTAAATGC ATCACCAACCCTAGAGTTTAGGTCCTGA ACATTGTTAGCTCTGCTGTGCGAAAACA | 0.01809196 | 0.007620008 | 2.94E-06 |
| 72 | 3475900 | 2 | ABCB9; RP11- 197N18.4 | AGAATGAAGCATCCTGCAGGAGCCCTGG CTCGATGCCTGGTAGCCACTATAAATAA AGAAGAACCAGCAGGCTGTGTGGATGCA AGGCCCAGTGCTCCCCTGTTCTCTGAGG AGG | 0.000368854 | 0.025422078 | 2.24E-05 |
| 931 | 3475981 | 2 | PITPNM2 | TTCCCCATCGACGGGAAGGCTTGGACTC CAA | 0.00592778 | 0.007346276 | 5.13E-06 |
| 267 | 3476305 | 5 | ATP6V0A2 | CCTGAGCCACCAGTTATCACCAGTAACA GGGGATGACACACCTACCTCCTGGGGCT GTTGTGAGAATTAAGAAACACTAAGTAA GGAAAGCACACTCTCAGGTATGCGGCA | 0.040585072 | 0.011750362 | 7.01E-06 |
| 347 | 3476911 | 8 | TMEM132B | ACCTGCCTGACATTGCCAGTAATTACCA TCTTGGTATGAATTTCAGTGATGCAGAA CCCCTGTCAGAGACAGCTGCGTTTGTAA AAGCAAGTCTGGATGACACAGTGATGAT TACATCATCTCCATCTTCATCGCCATCTC ATAGTAAAGTTAACCCACTGTGGCATCT GGCTGATGGTTTTGTGGGAGAGGATTCT ATGTCCCACCGCA | 0.001093286 | 0.011585565 | 1.01E-05 |
| 366 | 3481437 | 4 | TNFRSF19 | GTACCTGCCTGCTAAGGAACAGACCCAC CTGCCTGCTGTGGTTGTATTGCCAGAAGT GTTGGATTCACATCTTGGCTGCGCTTTGT ACTGATGGTGTAACCTTGGGCAAATAGT CTCCCCTCTTTGAACCTCTGTTTACTCTG GAAAATGCCCAAGTCTGCAGATTTTGGA TAGAACTAAATGAACTAGTAGTCCAGCA ACATGATA | 0.001095886 | 0.012314567 | 6.70E-06 |
| 798 | 3481446 | 4 | TNFRSF19 | TCCAACTCCTACCTTGGGAGAGAATGAC AGTGAACCAAACAAGTAAAGTAT | 4.12E-05 | 0.011301562 | 3.72E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 945 | 3481456 | 9 | TNFRSF19 | TGCGCTTGCTCCCATCCATGTGCTGTGAG GAGGCCTGCAGCCCCAACCCGGCGACTC TTGGTTGTGGGGTGCATTCTGCAGCCAG TCTTCAGGCAA | 2.53E-05 | 0.009087909 | 6.89E-06 |
| 1490 | 3482106 | 6 |  | GCCCCAACATTGAAGTGCCAGGATCAAA GCCATTCACTAGCATCTCCTCAAACACCT GCCTGCCATCACCACCACAAGTGCCAGG ATCAAAGCCATTCACTAGCATCTCCTCA AACACCTGCCTGCCATCACCACCACAAG CACCAGTAGGAAATCCTCCCTTGGTGC | 0.009647164 | 0.006783836 | 4.16E-06 |
| 879 | 3484182 | 1 |  | ACCGAGAGCCCTGATGGGCCAGTGTCTC GGTGGGGTCTGTGCAGCATACTGAACAC AGCGGCGATCCTGAGGGACCCGTGATGC TTCTAGCCCA | 0.00587839 | 0.006816243 | 3.47E-06 |
| 1905 | 3485957 | 7 | POSTN | CATAACATACATACAAGGCTCGGTCTTT TCAATGGGATAACAGTTCACAACTCTTC GATTTGAATTGTAATGAATCTGGTGACA AGGATTTTCTCTAATGGATTCCAAAGTT AGCCAGAACTTTTAATGTCAAGATGAAA AAGGGTGTAAGGTGTTATATTTTCTTCAA TTCCTTTACCACAGGAGGCTAACTCCAC AATTTCCCTCATGTTTCTCATTCAGAAAA AAAAATATTAAATTTGTGTTCAGAATTA TTTGATGATTGCTTCTTTGTGCTGATGTT TCAGTTCCTGAAGTCAACTTGGCTCTCA | 0.000905174 | 0.006832111 | 4.62E-06 |
| 1492 | 3487850 | 4 | SERP2 | CATTTGGGATTGTGTAGAGGCTCTCTCTC AGAAGCATCTTTCTGTTATTTTAATGCGG ATAGAAAGCTTTACATTCTTTGCTAATAA CATCTGGGTTTTAATAGCGCCTCCTTGCC CTGCCTGTCTCCGGCATCTCTCTTTTTTC CCTCTTCTCCATCTCTAGAGAAGCCACCA GAAAATGGCATCTTGCTTTTGACTTTCTT TGTGCTGATTCTTTTAGAGAACTTAGTGA TCCACTTTGCAATGTCTCGTCTCCTAACA TTTTCAGCTTGTTTCTCAGAGGGCCTGTAC TTTGCTTTCTACCAGCTCTTTCATCATTTT CATTTTCTTTAATGAAAAATAAGCAAAA CTGTATGATTTCTAGGITGTCTTCTTCTC CTAAAGGATATTCTTCTTCCGGCCTCTCT TAATCTCTCTTCTCAGCAACTCCCTTGAT CTCTTTTATCATCAATTTATTGTCAATAA AAGTGGCTTTAGGAAGCCTCCTGTTACC TGGCAGGGTTCCAGCTTTCTGACACTTTC CTATGGGACCCACTTGTTATGTCA |  |  |  |
| 1469 | 3492720 | 5 | PCDH9 | CCAGGTGATGGTCTTTAATTAGAGACTT GAATATTGAATCAAAACCACAGAAGATT ATGTTATTACAGCACAACCCTCACCTTG AAACGTGAAAAATGTGTTAAATTATTTT GCTACTTTTCCTTTTAGCCAGGAACTATT CAATACTTTCACAAGTACCTGTTTAACTC AGCCCACTACACTGGCCATCATAAATAA CCAAAACGTGATTTCTTTACTTTCTTTAA GGAAACAGTATCTCGCACTTCCAGTG | 4.68E-05 | 0.008721471 | 8.18E-06 |
| 551 | 3494195 | 4 | LMO7 | GATTATTGAGTTTCGTATGCTTTTCGAAT ATGGTAGGATGTTAAATGTGGTAAAAAG AATGGCTCTTAAATGTGTTTCATAGATCA TATATTAAGCTTGACTAGTGAGAATATTT TTCATCCCTCTATTTTAGTTATACATAT CTTGAAGCCATTTCTTCTGTTTTAGAATG TCAGCATATGATTTGCTAGGTC | 0.000367918 | 0.009638476 | 5.96E-06 |
| 1976 | 3494747 | 1 |  | TTGGCTCCACTAACACACTGCACTAACT GTGGTCCGGGGATCAGGAAGCAGCATCG TGGCTGCATCATCATGCCTGCCACATTTG CACCAACAG | 0.001265835 | 0.006763304 | 1.25E-06 |
| 1887 | 3497274 | 3 | DNAJC3; RP11-10E18.2 | TATTCATTTATTGATCTCCCCACACCATC CAACATCTCTACATGATG | 3.19E-05 | 0.009677701 | 3.97E-06 |
| 87 | 3497377 | 4 | HS6ST3 | AAGGCAGGCAGTCATCGCCGGAGTCCTA AGCGGCAAAAA | 7.38E-05 | 0.027178585 | 2.76E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1082 | 3497692 | 2 | RAP2A | TTCCTTCTCGCCTTTAAGGGCTATGGTTG TAGTGTGACCCGTGGCTAACCTGCTTTCA AAATCAAGTATTTGCTGTAGCAGAGCTT TATTGCAGGCATTTTAAAAATTGAATAA CCATGTGAAATAATTTGGGCTTAAAAGT GAACATAAATTATAGAGTGGAAGGTAAG GGACAAAAGCCTTTTACCTTTAATTTTCC TGGAGAATTATATAAAGGTTTTCTTAGA ACAATTTTGCCCTGATTACTGAAGCGTC AAATAAAGCTGG | 0.008795089 | 0.007805083 | 5.00E-06 |
| 1882 | 3499158 | 9 | ITGBL1 | GCAGGTGTAAGTGTGATAATTCAGATGG AAGTGGACTTGTGTATGGTAAATTTTGT GAGTGTGACGATAGAGAATGCATAGACG ATGAAACAGAAGAA | 9.32E-06 | 0.009461541 | 7.12E-06 |
| 1993 | 3499164 | 9 | ITGBL1 | GTGGTGAATGTACCTGTCACGATGTTGA TCCGACTGGGGACTGGGGAGATATTCAT GGGGACACCTGTGAATGTGATGAGAGGG ACTGTAGAGCTGTCTATGACCGATATTCT GATGACTTC | 1.12E-05 | 0.007754542 | 4.29E-06 |
| 521 | 3499195 | 9 | ITGBL1 | TTCTTGTCATTGTGGGAAGTGCATTTGTT CTGCTGAAGAGTGGTATATTTCTGGGGA GTTCTGTGACTGTGATGACAGAGACTGC GACAAACATGATGGTCTCATTTGTACA | 0.002350957 | 0.016058117 | 1.81E-05 |
| 1459 | 3499197 | 2 | ITGBL1 | TGGTTCCTAACGAGAGCAATTTTTCCACC CAAAAGTCATTTGGCAACATCTACAGAC AATTTTGATTGTCACACTGGGTCGGGTA GGAAGGTATGCTGCAGACATTTGGTGGG TAGAGGCCAGGGATGCTGCTGAGCATCC CGCAGTGTACAGGACAGCCCCCAAACAA GGAATTATCCAGCCCCAAATGCCAATAG GGCTCAAACTGAGAAACATTGAGTTATA TGGCTATTAGAAATCCACATTCTTACAC AAGAAAGACCATATTAGAATCTAAGGAA AACATGCATATTCACATTAATTAATCGA TCAGATTTTTCCAGAATTCCGTATCAGTC ACCA | 0.000475873 | 0.009854259 | 3.60E-06 |
| 1261 | 3499203 | 4 | RP11-39708.4 | AGCCCAGTCGCTTTCCCTTGATATAGCCT TGTTCTGAATTAAAATGGAAAAAATATT TCAATTATTTTCATCTTGTTCTCAACTGG ATGTTAGTCAATGTGGTCTCTTTTTGAAT ATGTATCAAATATTAATGATCCATAATA TTAGGGAGATAATTTTAAATGAAGTGAT ACGTGTCTAACTTACTTAAAGAATAAGT TTTTGGTTTTTGCTTTTAAAGACAACCAA ATCTGATATTGTTCATCCTGATAAAAATA ACAACTTTTAGTGCTTAAAGCATTAATTA AGCAAGTGGCTAGGTATGATAAAGAACT TCTGCTTGCTCCCCAAGAGGCAAACTAT TAGAAGAACTGGAGCGGGAGTCCTTTGG ACCCATCGTGGATCTCTTTAAGCCACTGC TACCCAAAAACATTCAGGACAAGCAAAC ATTTAGAGCAAGAATCTCCAAATTCTTC AGGATTTGTAATGAAATGATGTTCAGTT CCATTTTGCTCTTTACATAGGGTGGAGA ATTGTCATGTCTTCTCTAATTTTTCCAAG TAAAGTGGTAGCAAAATGTTTTAAAAAG CAATCTTATATTAGAAAACAAAAATGTT GTCACTTGAAATACCAAAACAACATTTC TGAGCGTTGTTGAGGGACTGGCAAAGCA ATCAGCTACTATAACAAATCAGTAGAAA TAACCCTCCCACACCAGATATGCATGCA GAAGGAATGGAGTATTATAGAGACTTGA TACAATGGACATATGCACATGGAGGTAC AAAACACACAGTCTAAATACAAATGAAT TCCATCAGATTTACTATACGGAACATCA GTAGTGACAGATTGCACTTCTTACTTAAT AACAGCAAACTTAATTTCTGAGGGGAAA AAAATGGCGAAGTCTTATCCCAAACAAA TAGCAAGAGAGGTATCATCAAAGAGCTA AAATTTTCTTTGGCATGGTAAAGGGGGA | 0.013881148 | 0.006923667 | 2.88E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | AATTGAGTTTACCAACTTATTTACATGAC ATTTCTCTATATTGGTGAGTAATGCAATG CCATTTTGTTACATAAAGTTGTTTGATGT TTTTTAATATGCCTTCATATAAATATTTT ATTCAATATGTTGTATTTGTGAATTTAAC AAATGATATTAAACACAAACTACAATGC AGACAGACAAACTCTTTGTATGCAAATT AGCAATACATACCAACAGTTCTTGATAC ACAGGTACCTACTACATGCAGCTCATCA TTGCTGTCCTCTTCCCATGCTACAGGTGA GACCAGA | | | |
| 163 | 3499919 | 1 | | TGGAAACAAGCTGTGGACAAACTCTTCT CTT | 3.23E-06 | 0.02130792 | 1.70E-05 |
| 1020 | 3499954 | 1 | | TCCATGGTCCCGTGCCTGACTTCATGGAT GGTTCAATGCTGCAGTTCGTCCAGTTCAT GGACAC | 0.046404092 | 0.008798959 | 6.33E-06 |
| 158 | 3501363 | 9 | COL4A2 | TGGCCAATCACTGGTGTCACCGGGCAGC TGTCTAGAGGACTTCCGCGCCACACCAT TCATCGAATGCAATGGAGGCCGCGGCAC CTGCCACTACTACGCCAACAAGTACAGC TTCTGGCTGACCACCATTCCCGAGCAGA | 0.011533849 | 0.018104363 | 2.52E-05 |
| 1408 | 3502223 | 9 | ATP11A | ATTGGACACACACTACTGGACTTGGATC AACCATTTTGTCATCTGGGGTCGCTGCT GTTCTACGTTGTCTTTTCGCTTCTCTGGG GAG | 0.002212029 | 0.006829333 | 5.34E-06 |
| 913 | 3506074 | 6 | | TTTGCTGCGACCACCTTCCATCATAACCT TTGCACTAGTGATTGTACCAAATGGAGA AAACGCTTTCCGGAGACG | 3.18E-06 | 0.016317744 | 1.38E-05 |
| 1569 | 3507963 | 2 | KATNAL1 | TGGCGAGAGTTTGCTAGTCTCCCTCCCCG GCTTTGTGCTGGTATTCCACGTATTCCTG CATTAATATTGCACACCCAAACCAGTCT ATCAGGGAGGCTGAAGCAAGGGCCAG TGTGATATTTTAGGAATACAGAAGATTT AGAAATACCCCTATTTCTCATTTGCAGTT TTTTTTTCCAATTCTGTGCTCTGTCAACA TGAGGGACCTATC | 0.015967819 | 0.010333182 | 8.40E-06 |
| 1929 | 3510072 | 9 | POSTN | ACACACCCGTGAGGAAGTTGCAAGCCAA CAAAAAAG | 0.002951948 | 0.010200983 | 8.04E-06 |
| 1568 | 3510096 | 9 | POSTN | AGGGAGAAACGGTGCGATTCACATATTC CGCGAGATCATCAAGCCAGCAGAGAAAT CCCTCCATGAAAAGTT | 6.49E-06 | 0.008737308 | 7.60E-06 |
| 1777 | 3510099 | 9 | POSTN | GTCTATTATGGGAGGAGCAGTCTTTGAG ACGCTGGAAGGAAATACAATTGAGATAG GATGTGACGGTGACAGTATAACAGTAAA TGGAATCAAAATGGTGAACAAAAAGGA TATTGTGACAAATAATGGTGTGATCCAT TTGATTGATCAGGTCCTA | 0.000751323 | 0.008159496 | 4.59E-06 |
| 1332 | 3510150 | 4 | TRPC4 | TGACTATTGTAGCTCCAAGAACCTCACC CCCAAAGCCAAACAACTATTTTACAAGC TGCGGTGGACCCGCTTACAAAATCAGCT TAAGAAACGTAACCTTAAATTTTAGAAT TACAGATTTTAATGACTTCATATTCCACG ACTGACCCTCTGAGTTTTTT | 1.22E-05 | 0.008844699 | 3.51E-06 |
| 519 | 3511633 | 5 | TNFSF11 | CCCAGAAAATGAGAACACGGACACAGA ATCTCCATCTCACATTGTTTCCTGCTCTG CCTACTTCACCACAGATGACAGCAAAGG ACCAAGAGTTACAACTGCTICTCATCAG AGCCCTGGATCAA | 0.000595218 | 0.012364946 | 6.51E-06 |
| 463 | 3512032 | 4 | ENOX1 | TCAAAAGAGTGTGGGACTGGTGTCCCAA CAGAAAAATAGATCCTTGGAACAGAAG AAAGAGGCAGAAGTAGATCCACATGTGT ATAGACCGTGGATTTTAGACCAAGGCAT GGGGGCAATTCAGTGGAGAAAGGATTA ATTTTTCAACAAATAGTGTCAAAACAAG ATATCCATAAGCAAAAAATGAACATCAA ACCATATTTTATAATATATACAAAAATG AACACCACATGGACATATATGTAACACC TAAAACTATAAATCTTGTGGAAGAAAAC CTAAGAAATAATCTTTGTGAGATTGGGT | 0.033960096 | 0.007007489 | 5.15E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TAGACAAAGATTTCTTAGATATGACACT GAAAGTGCAATTC | | | |
| 1613 | 3513641 | 1 | | GCCCACACCAGGGACCATGTTTCATCCT CCTAAA | 7.74E-06 | 0.009463004 | 4.74E-06 |
| 1123 | 3517038 | 1 | | GCCATGTTGGGAAGCCGCATGACTCGTG GACAGGCGGGGAAAAAGAATTGTCACA TCTATGTGGATAACTTACCTTCAGGTATC CCAACCAAGGACACTGAGG | 0.012450296 | 0.006662742 | 3.90E-06 |
| 786 | 3517930 | 4 | KLF12 | AGCAGCTGTTTCCAGGTCATATTCAGCT GTTTTATTCCTAAAGATATAACAGAAAT CTTTAAGCTACATTTTGGTGTGTCTGTGT AGGCTGGCATAGGACAGGGTGGTGTTTA GTGGGAAATATCTGTGAACCAATTATTG CAGTTGACTTAAGGCTCCAGAAATTTCC AGAATCCATGTTCATATTCTAAAGACGT GCACATTTATGTATGCTCCATCTTTAGAT TTTCACTTTCTTTTTTCCTCTCCACTTCTT GCTCTATCCTGCTCCATTTTTAAGGTTTT AAAGGACTTGGGCATGTGTCGTTGCTTG ATAATGGTGGCGGTAGTGATTGTGCTGT GTACCTAAAACCAGTATCAAGGGCTGTT GTGTAACA | 0.00059375 | 0.008249929 | 2.90E-06 |
| 191 | 3521655 | 5 | HS6ST3 | TCTGCACCAGGAATGAGACACACTACAC TAGTTTGCTAATTTGTTTCCTAGGGCTGG CATGACAAAGTACCATCATCATGGTGGC TTCATCAACAGAAATATTTATTACCTCA CAGTTCTGGAGGTAAGAAGTCCAAAATC AAGCAATCTACAGAGITGGTGCTTCTAA GGGGTATGAGAGAACAATTTATTTCAGG CCCATCTCCCTCTATGTGAGTCTGTCTTC AA | 0.031823166 | 0.016338133 | 2.03E-05 |
| 428 | 3523505 | 7 | ITGBL1; RP11- 39708.4 | GGTACCTGTGTATCAAGAACTGTTGGTA TGTATTGCTAATTTGCATACAAAGAGTTT GTCGTCTGCATTGTAGTTTGTGTTTAAT ATCATTTGTTAAATTCACAAATACAACA TATTGAATAAAATATTTATATGAAGGCA TATTAAAAAACATCAAACAACTTTATGT AACAAAATGGCATTGCATTACTCACCAA TATAGAGAAATGTCATGTAAATAAGTTG GTAAACTCAATTTCCCCCTTTACCATGCC AAAGAAAATTTTAGCTCTTTGATGATAC CTCTCTTGCTATTTGTTTGGGATAAGACT TCGCCATTTTTTTCCCCTCAGAAATTAAG TTTGCTGTTATTAAGTAAGAAGTGCAAT CTGTCACTACTGATGTTCCGTATAGTAAA TCTGATGGAATTCATTTGTATTTAGACTG TGTGTTTTGTACCTCCATGTGCATATGTC CATTGTATCAAGTCTCTATAATACTCCAT TCCTTCTGCATGCATATCTGGTGTGGGAG GGTTATTCTACTGATTTGTTATAGTAGC TGATTGCTTTGCCAGTCCCTCAACAACGC TCAGAAATGTTGTTTTGGTATTTCAAGTG ACAACATTTTTGTTTTCTAATATAAGATT GCTTTTTAAAACATTTTGCTACCACTTTA CTTGGAAAAATTAGAGAAGACATGACAA TTCTCCACCCTATGTAAAGAGCAAAATG GAACTGAACATCATTTCATTACAAATCC TGAAGAATTTGGAGATTCTTGCTCTAAA TGTTTGCTTGTCCTGAATGTTTTTGGGTA GCAGTGGCTTAAAGAGATCCACGATGGG TCCAAAGGACTCCCGCTCCAGTTCTTCTA ATAGTTTGCCTCTTGGGGAGCAAGCAGA AGTTCTTTATCATACCTAGCCACTTGCTT AATTAATGCTTTAAGCACTAAAAGTTGT TATTTTTATCAGGATGAACAATATCAGA TTTGGTTGTCTTTAAAAGCAAAAACCAA AAACTTATTCTTTAAGTAAGTTAGACAC GTATCACTTCATTTAAAATTATCTCCCTA ATATTATGGATCATTAATATTTGATACAT ATTCAAAAAGAGACCACATTGACTAACA | 0.006310467 | 0.014771455 | 1.26E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TCCAGTTGAGAACAAGATGAAAATAATT GAAATATTTTTTCCATTTTAATTCAGAAC AAGGCTATATCAAGGGAAAGCGACTGG GCTAAATCCTCAATTTTTTTTTCCAAAAT GCAGGCATATCAAAATCCAGGATGTACA TGGTCTTACTTTGAGTGAAATAGTAGTC ATAGCTGAGGTTTCTTAGCCTACAATGT GACATAGGGCCTGTTGACTCTCTTGAAT ATGGAGTAGGGTTTCAAAGTGTTGACAG TTGAGTCTGCAAACTAAGGCTGAGTTAT ATTTTAGTTTTTTTTTTTTTTCCTGGTTTT CACTAAGTCTAATTCCAATGTCTACTGGC AGAGATTGTGTTTGCATTTGAGGTAGTG GAGGGCGGTACTTTCCAAGTGCTGTTGG AATCCAGATAAACTCAAGGAGCCCAGAA AGACAACGGGTATAATGGCTCTCCTCTT ATGACTTAGCACTTTAGTTGACTTTTTTG AAAAAGTCTCTGGGTGGAATACCTCAGT GATGATGATTTGCCAAACAAGCAGCGTT AGTGCCAACACCTTCTCTAAACTTGCTGC ATCCCTTCCAATTGACATTA | | | |
| 1471 | 3524517 | 1 | | AGGCACAGGCGGGAAGGCTGCATACTCT CC | 0.006129156 | 0.007067951 | 6.11E-06 |
| 1570 | 3525217 | 1 | | TGAAAGGGATAGTCACCTTGGGTTGGGT TGGAGGGGATGGTCACGTTGGGTTGGAA GGGACGGTCATCTTTGGATGGAAGGGAT GGACACCTTGGGATGGAGTAAGTGGTCA CCTTGGGATGGAAGAGATGGTCATCTTG GGATGGAAGAGATGGTCATCTAGGGATG GAAGGGATGGTCATCTTTGGATGGAAGG GATGGTCACTTTTGGATGGAAGGGATGG TCATTTTTGGATGGAAGGGATGGTCATC TTGGGATGGAAGGGACGGTCACCTTGGG ATGGAAGAGATGGTCATCTTGGGATGGA ATGGCTGGTCACCTT | 0.000794501 | 0.008468936 | 4.75E-06 |
| 799 | 3525316 | 2 | COL4A1 | CCCAGGTTCATGAATATGGTGTCTATTAT AGTGAAACATGTACTTTGAGCTTATTGTT TTTATTCTGTATTAAATATTTTCAGGGTT TTAAACACTAATCACAAACTGAATGACT TGACTTCAAAAGCAACAACCTTAAAGGC CGTCATTTCATTAGTATTCCTCATTCTGC ATCCTGGCTTGAAAAACAGCTCTGTTGA ATCACAGTATCAGTATTTTCACACGTAA GCACATTCGGGCCATTTCCGTGGTTTCTC ATGA | 0.00034347 | 0.014745656 | 1.67E-05 |
| 282 | 3525317 | 2 | COL4A1 | AGATGTCAGCAATTAGGCAGATCAAGGT TTAGTTTAACTTC | 6.70E-07 | 0.02435786 | 2.92E-05 |
| 120 | 3525318 | 2 | COL4A1 | GGTGTGGGTGCCTTCCATACTGTTTGCCC ATTTTCATTCTTGTATTATAATTAATTTTC TACCCCCAGAGATAAATGTTTGTTTATAT CACTGTCTAGCTGTTTCAAAATTTAGGTC CCTTGGTCTGTACAAATAATAGCAATGT AAAAATGGTTTTTTGAACCTCCAAATGG AATTACAGACTCAGTAGCCATATCTTCC AACCCCCCAGTATAAATTTCTGTCTTTCT GCTATGTGTGGTACTTTGCAGC | 9.07E-07 | 0.029855107 | 3.15E-05 |
| 1702 | 3525346 | 9 | COL4A1 | GAGATCAAGGGATAGCGGGTTTCCCAGG AAGCCCTGGAGAGAAGGGAGAAAAAGG AAGCATTGGGATCCCAGGAATGCCAGGG TCCCCAGGCCTTAAAGGGTCTCCCGGGA GTGTTGGCTATCCAG | 0.017555038 | 0.007078593 | 7.84E-06 |
| 1572 | 3525347 | 9 | COL4A1 | CTGGCCCACAAGGTTCACCTGGCTTACC TGGAGACAAAGGTGCAAAGGAGAGAA AGGGCAGGCAGGCCCACCTGGCATAGGC ATCCCAGGG | 0.002951948 | 0.008002999 | 5.89E-06 |
| 2002 | 3525376 | 9 | COL4A1 | TGTGGAATGTCAGCCCGGACCTCCAGGT GACCAGGGTCCTCCTGGAATTCCAGGGC AGCCAGGATTATAGGCGAAATTGGAG | 0.00140662 | 0.008255721 | 7.04E-06 |
| 1138 | 3527440 | 9 | PARP2 | GCTTTGGGAGACATTGAAATTGCTATTA AGCTGGTGAAAACAGAGCTACAAAGCCC | 0.000417578 | 0.009113313 | 4.95E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1135 | 3527672 | 2 | RNASE6 | AGAACACCCATTGGACCAACACTATAGA AACCTACATTGTGCCTTGCGCCCCCTTGA CCATGAAAGTTA TTCGAGTGCCTAGGATGCCAGACCAGAG TTGAGACAAAAAGAAATAAGATTATTTT CTGCTTTGTAGTTCTGTACTTTTCGAGAG AAGGGAATAGGGAAGACAGCAAAGAAA GATTCAGATTTCTAACCCTGCAACTTTTG CCAAGCTTTATTGCCCTG | 0.000909538 | 0.012047043 | 1.21E-05 |
| 1084 | 3527990 | 6 |  | CCAAACATCAGGCTGTTCACAAAAATAA CCCACAGTATCAACTTTAGAAAACAAAT CTTAAGACTATAACACTAATTATTTTTCT AGAGGATGCATTTGACATGCCAACTCTC ATTCA | 3.69E-05 | 0.017132822 | 1.65E-05 |
| 999 | 3528533 | 4 | AE000661.28 | ATGGTGGCTACTGCAAGGGGTTTTTTGTT TAGGGAGAACGCACTGTGGAACTCA | 0.005348101 | 0.006614602 | 5.62E-06 |
| 1208 | 3529692 | 4 | RNF31 | TAATCTTGTTCGTCCAGGTGTCTCAGAGT CCAGCTATGTTAGACACACTCAGTTAAT ATTAGCCAACACAACAAATATTCTGCTC CCTTTTC | 0.035044469 | 0.007877746 | 3.05E-06 |
| 980 | 3529894 | 4 | LTB4R | CAGGGGACATCCACAAGTACACATCTGT GGTCACTAAGGTGACCAGCTCATCCCAG TTGGCCTGGAACTTTCCCAGTTTAAGCAC TGAAAACTCCTTGTCCCAGCCCTGCCGG TTTCCCAACAAACTGAGATGGTTGGCCG CTCAAGTGGCTACCCTGACCATCACCCC AGGCTCTACTTTAGCGACTGCTCACACCT CCCTGCTTCCCAGACAGAAGTCAAAACA GCAAAAGAAACCCAGTCCCCAGGGTCAT GCTAGGGCTACCAAAACTGGGATGAACT AGCACCTGTGAACTAGAACAGCAGGGA GTATGCTTAGAGTGCCTGGTCCTGGGTG TGGGGAAGAAAGGCCATCAAGGTAGAT GCGGGTGGGGAACAGCTTGAGAGAGGA GGCAAGGACAACCCAGTTTCTGTCTGAA GGGGCCTCTGGTTGACCCTGGAGTTTCT GTCCCCAAACACAGGCCTCACGGGATTC TTTC | 0.045706551 | 0.007831994 | 3.62E-06 |
| 1869 | 3531193 | 4 | COCH | GCCATTAGCAAGATGGATAATCCTTGAT AAATAAACTTGTAAATACAGTAAGATGT ACAAAATATCACATAGTGATAGGATGCC AAGATTAGTTTTTTTCTTTAAGAGTTCAT TTGGAGTACTAAACCCCACTGTTTCATTT TAATACACTTAATAGTCCTTGGTTTATGA AGACATTTATGTGATGATGAAAGTTATT TAGCATCTTTATGGAAGGACTTAGCTGA GCTGTATTAGGCAAAAGAAGGAAAGAA AGTGGTTACAGGGCAACGGGTCAGTGAG ATCT | 0.030285522 | 0.006501799 | 5.60E-06 |
| 642 | 3532227 | 7 | SNX6 | TTCTGAGTATGACGAGTGCACGATGATG GACCACTGTCATGGGGAACACAGTGCGG CATCACGGCACACAGACTGGCATCGCCT GGGCGTGCGCTGCTCCATGTTTCTCAGA AAA | 4.38E-05 | 0.010058046 | 7.03E-06 |
| 1850 | 3533039 | 1 |  | GGCATGGGTATTTTCCAGCCCCAGATTG CTTGGTAAAATGATGGTGGAGAACAAAA AGGTGAGGGCTGCAGTCCTAGCTGGCCA AAGTTCAAAGAACCATGCTGGGCTGGGG CTAAAAGAAAAACCAATGGAATTATTAT GCCCCCAAACTTAGCTATTTGGAAGAAA AAACACAAGATTTAAGGTAATCTGTTGT TAAATGTTATTTGGATACACTAACATCGT GCATGAAA | 0.002187152 | 0.007213692 | 5.97E-06 |
| 327 | 3535010 | 1 |  | CTAGTGAGCTGAACAGGCAAGGAACAC AGAGGTGAGATCAAGGAAGGCAGAACA AGAATGGAGCGGGATTTAGGAATTAAAG CAAATCTGCAATTAAATATAACTGAAGT AATGGTAAATTTCAAGAGAACTAGACTG TAAGAACTAACCTCACATTGTGGGAAAA TAAAAATTTTAACCTTTTCCCCCTTTATT | 0.002182207 | 0.013765072 | 9.95E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
|  |  |  |  | TGAAATGTTCTATGACTACTTGAAAGAA TTTAAAAATGAAAGTATTTGTCAGTTTTG TCCTTGAATATCTTTCATTTGTTATAGAA TACATATTTTGTCCATAGTATTTTGTTTT ATAAGTGTGAGGGTAGATTTTTTTATTGA GAGCCTACTAATATGCCTGG |  |  |  |
| 1102 | 3536724 | 4 | LGALS3; AL139316.1 | GGTCATTGTCTTTCCTGTCTCAGTAGTAA TCAATCACTGCTTATCTTCAAAAACCCA GAGTAGGGGATGGGGCAGTTAGTGGGG ACAGAGGGCAGATGGGTAAGATTCAGA GCACAGGCTAGTGTGACGGAAGTTTAAA CTTGTGAGTTAAATAGGGTTTGGCAATC TAGCTGGATAGCATCCCTGCCCCTTGAA GAGATGTTTTGTGGCGCCACACTACTG ACTTAGG | 0.011264381 | 0.007864671 | 3.99E-06 |
| 1162 | 3537877 | 7 | C14orf37 | CTTTATCCCGTGAGGAGCACGCGGAAAC CTCTACCCATGCAGGATGTTTCTAAGAA CCACTTCTTCCCTGTCTTAACTAAGAAGG CTCCCACAGCTGGTGCCAATCAGGTGGA GAACATGGCAAGTCCCCGAAATGCACTT CCAAAGACAGGAAAGATTGCAGTGGGA CAGAACCCAGAAAATCTCTCACATTCTC GAAAACCCGAAAGAGAACCTCCAAGAA AGACGTTTGCCTCTCCTCCACCTCTTTAT CTCGGCGGGAGAGGAAGCCTCGCCCCCA TTCATCCCGCCCCTTCTCCCACCCCGCC GCAGGGAGAAGTTTACCATGGCTGCCTG CGGCCCCTTCACTTCCGGTGCCGGTGCC GCTAGGGCTGCGCCATCCCCCCAGTCAA TCGGACAACCATAGCCTCCAACTGACCT TTCTGACAGCTCTGAGACTCCTCCGGCC ACGACTAGGTGCTGTCCTGGAGGAAACG GTGGAGGACGGCCGCACAAAAACCAAT CTA | 0.039082309 | 0.007619176 | 4.86E-06 |
| 766 | 3540148 | 2 | HSPA2 | TTGCACTCAAGTCAGCGTAAACCTCTTTG CCTTTCTCTCTCTCTCTTTTTTTTTTTTG TTTCTTTGAAATGTCCTTGTGCCAAGTAC GAGATCTATTGTTGGAAGTCTTTGGTATA TGCAAATGAAAGGAGAGGTGCAACAAC TTAGTTTAATTATAAAAGTTCCAAAGTTT GTTTTTTAAAAACATTATTCGAGGTTTCT CTTTAATGCATTTTGCGTGTTTGCTGACT TGAGCATTTTGATTAGTTCGTGCATGGA GATTTGTTTGA | 0.014622507 | 0.007412038 | 3.46E-06 |
| 927 | 3540771 | 1 |  | CGGGGATATTCAGGCCAACACTAGGAAA CCACAGCCAAGTCAGGCAGGGCTTGGGG CGGAACTGCTGACACCTCCACCCTAGCC AATCCAAGGTGCACGCCTGCCTCATGCA GCCCAGCGTGACTCCCGCCATTGGCACA CTGTGCCCATCACAGGCTGGAGCTCCTTT CCTCCACCGTCTTCCCAACTCCTGCCAAC CAGAACTTAACTACTCCTTTGGATTCTGC TTTTCACTTGTTCTTCATCAGACTATGGA AGCTTAGACTTCATAATTTGGCTGAGAC TTCAAAAATAGTTTTAAAGAAAGCTATT CCCACCCTGCTAAAGTAATTACATGATT CTGCCCCCTTAAACACCCAAAGCCCTAA TCTGTGTTCTCA | 3.85E-06 | 0.010896849 | 6.72E-06 |
| 1630 | 3542092 | 2 | SLC39A9 | TTGGCTACCAAAGAGACGCAATTGATGA TGAGAAGCATGATTCTTGCTTCCATATA ACCAAAGTTAATCTTAATTGCAATTTGA CTCCGTTTCCTTGGTAGGGATAGACTTTC TTCAGATTCCAAGTGCTCTCTTAAATGGC AAATTAAGTTAAAGAATACTACTGCTCC ATTCCCCTCACTTATTCTCCAGTTAATTG CTTGTCAGTTCCATTTCAAGAAAGCAGT GATGTTCCAGGTTTGATTCAGTTTTCCTG TGCACACTATTGCCAAATTTTTTTTTAGC AAAGATTCTGCACTGGAACGTAGACAGT TGGAAACAGTACTACCTACCTAGAGGTT | 8.12E-06 | 0.010138736 | 5.76E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 2031 | 3542093 | 2 | SLC39A9 | ATGTGTTTTCTCTTTCTCCCCGCTTTCACC TCTTTCTTTCCCAATTCAAAACAGCCAAG TGAGCCCTGTTCTGGTATTTTGAATCATT AGAGAAAAGAAAGGGAGTGGCTGTTTTG AGTTGTCCTTTCTTTGCAGAAAGGAGAA AATGTGATTGTGTTTTTTTTTACCAGCC TACTTCTAAGTGTCACTGCCTGGTTTTTC ACCAGCATCGGAGTGTATTAAGCCCCTG AAACACATGGTAGCTAGGGACTGAACAC AGGAACCGTATGACAGCAGCACAAACCC CCAAAGGATGTTCCTGCCTTGTGGGCCC CTGAGCCCCTTGGGAGACTGAGAATCAT GACCAGATTCATCCAGAACTGCTGCAGT GTTAAGTGAAAATCCTCTGTAGTTGTTCT GCAGAGGAACCTTCCTTCCATTAGAAAA TTTCTGCTCAATACAGAATGGTCCACATC ACCCAAAGTGCACTGTTGGAGATGCTGT GAAATTAAAACCTCTTTGTACCTGAGAC ATCTAGATTCACCTCAGGAGGCCTGAAG GAAATGTGTAACTTGTGGGAAAGAACTA GACAACCATTTAGGAATTCTCTAGATAT ACTCAGCCTAACCCAGTGGCTTAACACA AGGAGATTGGCTTTGATCTTTTTTTCTTG TGGCATCTTCCAGCAAGTTAGAAGTCTC ATGGGATAAGACTGCAGTTCCCCTGGTT CAATAGCTGGAACAGTG | 1.71E-05 | 0.008672443 | 6.82E-06 |
| 1583 | 3543814 | 8 | C14orf43 | CCCACAGGGTGTCCATGGGAAGCTGGGA TA | 0.047987301 | 0.006772589 | 5.92E-06 |
| 1412 | 3544272 | 9 | YLPM1 | GGACCTCTTCGAAGGGCTGGAGTAGAG AGAGAATACCACCCCGAAGAGCT | 0.003965967 | 0.006997005 | 4.50E-06 |
| 750 | 3544533 | 4 | FOS | GAACTCTAGCGTACTCTTCCTGGGAATG TGGGGGCTGGGTGGGAAGCAGCCCCGG AGATGCAGGAGCCCAGTACAGAGGATG AAGCCACTGATGGGGCTGGCTGCACATC CGTAACTGGGAGCCCTGGCTCCAAGCCC ATTCCATCCCAACTCAGACTCTGAGTCTC ACCCTAAGAAGTACTCTCATAGTTTCTTC CCTAAGTTTCTTACCGCATGCTTTCAGAC TGGGCTCTTCTTTGTTCTCTTGCTGAGGA TCTTATTTTAAATGCAAGTCACACCTAGT CTGCAACTGCAGG | 0.004800285 | 0.008329058 | 7.28E-06 |
| 181 | 3544721 | 4 | TTLL5 | GGATCAGTGATGGACAGGGCCCATTTGG CTGCCTTCTTGGAGTACCCAGGGTAGTC ACGTTTGTGCCAGGCCTCTTGAAGTCCA GCAACCACAGTGATAGCCTTTTGGCCAC AGCTCTTTTCTGTGTTACTGATGTCTCTC ATC | 0.008619147 | 0.018014742 | 1.83E-05 |
| 2075 | 3545532 | 6 | | CTTCAGAAGAAGGACTTCGGAATGCACT ACAACAGGAAAATCATATTATAGATGGA GTA | 0.003188906 | 0.007127484 | 3.35E-06 |
| 1376 | 3546925 | 4 | FLRT2 | AGGCTTTGTCTTTCACCTGGAGAGAAAA TAGGCAGCTTAGCTCTCTCTCGACTTTGG GGACATCTGTCTGCTGGTCGAATCCACC TC | 0.013721065 | 0.007711219 | 4.82E-06 |
| 1105 | 3549156 | 5 | ITPK1 | CTGGATTCTGCAGTATGAACAGGGCAAC CTCACCAA | 0.00247563 | 0.007281351 | 2.35E-06 |
| 298 | 3549159 | 5 | ITPK1 | GACGCTTCCTGGTCTTTGGAACTGACCTG AGGCAATGCATCTCCATTCCTGGCTTTGA CTACGATGGTTCTGCGCCCAGCTGGACA AGGAGCACAGTCCAGGGCCCTCAGGTCA AGATGCCTCCTCCTCAGAGTCTCAGCCCT GCACCAGGCCAAACGGGAACCGA | 0.000122396 | 0.011814315 | 4.49E-06 |
| 410 | 3550007 | 7 | CLMN | TGGAAGTTTCCTACAAGGGGTGACAGCT CTGGACAGGGCATCAGGTGCCTGTGTGC TCACTGCAAGTCTGCCCCTGGTCGGCTAT ATGATCTTGGTCAAGCTGCTCTGTCTCTC TGGGTCCAGCTAGACAAGATGCTCACTG AGTCCCCTCCTGACTCATTTGTGATTTTA TAAGGGTTGCCTGGTACATGCTTTCTGA AGGGGAGAGCAAGGGGAGGAGGAACCA | 0.024191116 | 0.007528968 | 1.46E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ATGCAGAGACTCACCACGGACCTGAGTC TTGGCAGGGAGGAGAGAGCAGAGGGAG CCTGGGGCTGAGGAAGACTGGGGGCAG GGGTGCTAGAGATGCCTCTCTTCTTTCAC AAACCTCCTGTGCTGGCCTGCTCCCGGA GTGCTGTCCAGAAAGCCTCTTCAAGAAA CCCATTACAAGTGACCACAAAGAATGCC CGTTCCAAGACATGCATTCTGAGGGAGG TGTGCACCAAAGCTTTAGTGGGCAGGAA GCTACCCCACCACCCAGCTCCAGCACTG CTGGGAGCTGATTCCAGCCCAGCCACTC CTCATGGCTTTTATATGGCCCTGCTGGGC CCTGGCGATCTGGTTTGAAAATC | | | |
| 1182 | 3550126 | 1 | | ACGGGTTGAAGATCCGAGAGGCTGAGTC ACTTCCACAAAGTAACACAGCTG | 0.019902689 | 0.006509539 | 3.04E-06 |
| 1307 | 3550432 | 9 | PAPOLA | GTTTGAGGTGGATATGAAAATTGCTGCA ATGCATGTAAAAAGAAAGCAACTCCATC AACTACTACCTAATCA | 0.002543079 | 0.008731933 | 6.43E-06 |
| 1152 | 3550451 | 2 | PAPOLA | GGGTACAAGACTAGACATGACTGAAATG GATTTGGGTTTTTTGGTGACCTCCCTTAC TGGGCTAATCAGCACTTGATCGGAAGTC CAGGTTAGTATGTGAAGCCAGG | 1.66E-05 | 0.015015134 | 8.97E-06 |
| 620 | 3551602 | 4 | EVL | TTGCCACTTGTGAGATATAGATTTGTACA GATGTGTCCCTGAAGCCACATATCCAGA TCTGTTTTAAACTTGCCATCCTGTTTCCA TATTCCAGAGCAAACATTTGAGAGAGAT GGGAGAAAACAGTCAAGAATTTATTTTT GAATTTAATTATTCATTCATATGTTTAAC AAAAGTTTATTAAATGCTTACTGAGGGC AAGAAACCGTGTAGGCAAAATAGATAA GAAATGAACAGCGGCCTTCCCCTCAAGG CATTTAGTTTTTCATGGTAGACAGGTTCA TAAACAGCTAACTGGAATGTATTGCAGT AAGTGTTTAAATAAAGGTACGTGCAAGG TACTTAGGGACCACA | 0.001526056 | 0.010602987 | 6.67E-06 |
| 1243 | 3552386 | 1 | | AGGAAGGCAGACTCTGGTGAAGACGTG GGCCGTCACCGTCAGCCTT | 0.000731459 | 0.00793614 | 3.48E-06 |
| 515 | 3553052 | 4 | WDR20 | CACTGACAGCACATTCCACTTGAGACCA GTGCTGCGGGACTGGGGAGTGCAAGCGT CAGGGTCCCAGCCGAAGCCCTTTAGCTT GGGACTTCACAGCCACAGCCTGAGTCCC AGCTCACAACTCCAGACCAAATTCCCCT CCCAGCTCATGTGCTGCGATCAAGACAG ATGC | 8.57E-07 | 0.018753834 | 1.95E-05 |
| 1912 | 3553727 | 9 | MARK3 | ACAGGTGGATCAATGCAGGGCATGAAG AAGATGAACTCAAACATTTGTTGAACC AGAGCTAGACATCTCAGACCAAAA | 0.00041969 | 0.007515649 | 5.85E-06 |
| 134 | 3553758 | 2 | MARK3 | CCGTTACCCTGAGAGTCGGTGTGTGGCC CCATCTCCATGTGCCTCCCGTCTGGGTGG GTGTGAGAGTGGACGGTATGTGTGTGAA GTGGTGTATATGGAAGCATCTCCCTACA CTGGCAGCCAGTCATTACTAGTACCTCT GCGGGAGATCATCCGGTGCTAAAACATT ACAGTTGCCAAGGAGGAAAATACTGAAT GACTGCTAAGAATTAACCTTAAGACCAG TTCATAGTTAATACAGGTTTACAGTTCAT GCC | 0.000265615 | 0.022135548 | 2.26E-05 |
| 166 | 3553838 | 9 | C14orf153; RP11-73M18.2; AL139300.1 | GATAAATATTCAAACCTTCGACCTGTTC ACTTTTACATACCTGAAAATGAATCTCC ATTGGAACAAAAGCTTAGAAAATTAAGA CAAGAAACACAAGAATGGAATCAACAG TTCTGGGCAAACCAG | 9.17E-05 | 0.018661694 | 2.19E-05 |
| 1681 | 3554544 | 7 | CDCA4 | CTCTTAGGTCTAGGAAGATGTGGCTGTG TGCGGCTCCTGATTTTCACCCAGGTCTCA CTGCAGCGCAGGACATAATGAAGAAGTA TCACACACACATTTAAAGTAAAACATGA TACATTCACACT | 0.001054975 | 0.010173309 | 7.36E-06 |
| 1287 | 3554623 | 2 | PACS2 | CGCCGCCCGCGGGCCTGTCCGACGCCGG | 0.009193693 | 0.006617289 | 5.66E-06 |
| 1932 | 3554841 | 2 | CRIP2 | CTGGCATCCTCTGGGCGTCCCATGATCCC TTCCTGTGTCTGCGTGTCCAATCCCGTG | 9.17E-05 | 0.007654287 | 3.52E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | TGACCCTGTCCCAGCATTTTCCCGCCGAC CCTGCGTGTCCCCGTGGCGCTGTCCGCTC TCCCTCTCCTGCTGCCCACCCACCTGCCA GTGTTATTTATGCTCCCTTCGTGGGTGAT GGCCACGCCCTCACCATGTCCCTGGCAG AGGGCTTCCCTCCGGGATCCCCTGCCTG GTGCCCACACTGCCTCGCAAGCGCTC | | | |
| 351 | 3556347 | 9 | SUPT16H | AATTGAATTCCGTGAAGGCTCCCTAGTA ATCAATAGCAAAA | 1.29E-06 | 0.02158001 | 2.25E-05 |
| 568 | 3557916 | 9 | TM9SF1; RP11-468E2.1 | TGCCAATGTTTCAGTGCGGGACGTCAAG CCCCACAGCTTGGATGGGTTACGACCTG ACGAGTTCCTAGGCCTTACCCACACTTAT AGCGTGCGCTGGTCTGAGACTTCAGTGG AGCGTCGGAGTGACAGGCGCCGTGGTGA CGATGGTGGTTTCTTTCCTCGAACACTGG AAATCCATTGGTTGTCCATCATCAACTCC ATGGTGCTTGTGTTTTTACTGGTGGGTTT TGTGGCTGTCATTCTAATGCGTGTGCTTC GGAATGACC | 6.72E-05 | 0.01010437 | 7.35E-06 |
| 243 | 3557960 | 4 | TM9SF1; RP11-468E2.1; AL096870.1; CHMP4A | TTAGAACTCATACTGCCACATCTTGATTC CTGCACAATCTCTTATTAGTTGTGATTTT TAACATCTTTGTGGTTGTTTTCACATTTT TAAAGTGAAGAGATAGCACGTTCATTGT AGAGATTTGGGGATTAGCAATAACACAG TCAGGTCTCTAGCACATACTATGTATTCA ATGATTGGTGGCTAATATTTTTCCTTCAC AAAATTTGGGCCTACTCCACTGGACTC | 0.000191608 | 0.016704805 | 1.10E-05 |
| 960 | 3560007 | 8 | AKAP6 | AGCTTAAAGGACTGAGAGTAGCAAGCAT | 0.009417954 | 0.009483293 | 6.50E-06 |
| 637 | 3560223 | 5 | NPAS3 | ATGTTGCAGCGGGACCCAAGTCGCAGAG CAGACAGCAAT | 0.006389661 | 0.009451309 | 7.54E-06 |
| 937 | 3560438 | 2 | EGLN3 | GCGCCTCGGCTTCGCGCTCGTGTAGATC GTTCCCTCTCTGGTTGCACGCTGGGGATC CCGGACCTCGATTCTGCGGGCGAG | 0.001877871 | 0.009109859 | 6.72E-06 |
| 1960 | 3561338 | 9 | MBIP | GTGGTCCAGTGCCAAGAGACATTTATCA GAGAATTAAAAAACTTGAGGATAAAATC CTTGAATTGGAAGGCATCTCTCCTG | 0.001877871 | 0.00715965 | 1.92E-06 |
| 220 | 3561724 | 1 | | TTGCAAAAAACTGCCGAGATCAATACAA ATTCCTTCCAATGCTGGCCAAAGTAGAA GACCTGTCACCCAAATTAATTAACCTTTC CTCAAGATCAATTGGTTTTCTGTTGATTT AGCAGTAATATTGTAGAACATTTAGCTA TAATGTATTTTAATGTGATCCCTCAATGT CAACA | 5.66E-05 | 0.02169482 | 2.54E-05 |
| 124 | 3561767 | 8 | CTD-2058B24.1 | ATGGGCAGTTTGACAAAAGAGCCACCCT CTGAGAGAAGCAAGAAATCTCCTCGGTG GCCTAACCAGGCACTCTACCTGCATCGC TCCAGGAAACTGCTATG | 0.000146145 | 0.013827712 | 1.59E-05 |
| 2008 | 3562015 | 9 | TRAPPC6B | GGCATCTATGTACTTCAGGACAACAAAT TTCGCCTGCTTACTCAGATGTCTGCAGGA AAACAGTATTTAGAACATGCATCTAAG | 9.90E-05 | 0.007586042 | 5.75E-06 |
| 1774 | 3562032 | 6 | | TGCTAAGGCCATCCATTGTCTTTTGTTAG GAGTCAAACAAAATTTTAGTAACCAAAA CATATTTTCAATAAAATTTTATATGTATA TAAGTAAATAACAAAACAACAAAAAAC AAAAAAAGAACAAAACAGCACCAAGAA CCTATGTAAAATTTCATCATACAATTTCT ATGCAAGCTGCTTGATTACAGAAAACTG TTCAAACTGTTCATCAAAAACTGAGTGG GATTTTCCATTGATATTTCAGATATTCAA ATCAACCCATATTCTGAGTATCAATCTG AATTGCACAGGTTAAGATGTGAACCCTT CACATAGTGTTGAAGATGTGTTGAAATC TGTACTTGAATTGGCATTGTTTTCCTCAG AGTTAGGCTGCCTTCATGAGAAATATCT TCTATCCCTGAGAGATCAGCTACATC | 1.42E-05 | 0.009799503 | 2.98E-06 |
| 1589 | 3562055 | 5 | CTAGE5 | CATCCCGACCCTCTTGTTATACTTTACAT CCCGAGGCAGCGCAGGTCCGAGCCCGAC CCGCACAAGCCTGCGACGTACCCTGTCC TCGCCACCCCACCCCTCGGTTTGGTTTCG GCCGGGCAGCCGCGAGAAGGCGGGGAG | 0.03244577 | 0.007294252 | 6.93E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GCGCGGACAGCCGCAAACTTCCCCTTCT TCGCGCAAGCTTCGCAGACGTGTCCGGG TCGTTTGCTCTTAAAGGGGCCGGCGCTCT ACCTGGCGAAGCCACCCAGCCCTGGTAG TGGAGAGGCTTGGGACTAGAGGATGAG ATTCGGCCTCATACTCCGCGCTGT | | | |
| 1543 | 3562729 | 9 | FKBP3 | GGTCCACCAAAATATACTAAATCTGTTC TGAAAAAGGGAGATAAAACCAACTTTCC CAAAAAGGGAGATGTTGTTCACTGCTGG TATACAGGAACACTACAAGATGGGACTG TTTTTGATACTA | 0.000158328 | 0.012294869 | 8.50E-06 |
| 1394 | 3565024 | 9 | DDHD1 | CATCAAGTAGTGGTACCAGACTTCATAG AGGTTATGTAGAAGAAGCCACATTAGAA GACAAGCCATCACAGACTACCCATATTG TATTTGTTGTGCATGGCATTGGGCA | 0.014650635 | 0.00854315 | 5.67E-06 |
| 144 | 3565594 | 9 | WDHD1 | TACAGGATTTGATGGGGATCAGTGCCTT GGAGTTCAACTGCTAGAGCTGGG | 3.92E-06 | 0.029618511 | 3.19E-05 |
| 1320 | 3565810 | 1 | | GTACATAGGCTATGCAAAAGGAACGAG ATATGCAGAGGCAGAGCCCAGAGTAGAT GCCAGAAAGGCAGTGGAAGCAGAGACT CGTGGCA | 0.039419514 | 0.006735638 | 4.08E-06 |
| 1803 | 3565943 | 1 | | ATAGCGCTCTCTCGACGTCACTGTGTCCC GGCTTACAACTAGAGGTGTCGCACACAC CCACTTGGGTGCCTCCCCTTCCAAAACC AAGCAGAAAGGCGTCTAGAAAATTAGA AGGTTTTGCCAGTTGGTGCTGGCGTAGA GGACGTTTCGAAGGCGCTTGGAGCACCC CACCGTTGCACTGGATGTAGCTACCCCG GCTTGTGGTCAATAGAGCTCC | 0.009323916 | 0.006563171 | 4.38E-06 |
| 898 | 3566362 | 1 | | CTGCTACTGTGGAATAGGTGGAACATGT ATAGTGGGAACCACAAGCTGTCACTGCC ACATTCTTGCATGTCTCAAGAAGCTACT GGCAGGCTTCCCCTTTTTGCCTTATTGGC CAGAAAAGTATTGCATGCCCGCGCCTAA GCCAACCATGACAAGGGAATGGTAGGTA CCATCATGATTAGCTTA | 2.38E-06 | 0.01176147 | 1.04E-05 |
| 733 | 3570152 | 7 | SLC39A9 | GCCTCCTGAGGTGAATCTAGATGTCTCA GGTACAAAGAGGTTTTAATTTCACAGCA TCTCCAACAGTGCACTTTGGGTGATGTG GACCATTCTGTATTGAGCAGAAATTTTCT AATGGAAGGAAGGTTCCTCTGCAGAACA ACTACAGAGGATTTTCACTTAACACTGC AGCAGTTCTGGATGAATCTGGTCATGAT TCTCAGTCTCCCAAGGGGCTCAGGGGCC CACAAGGCAGGAACATCCTTTGGGGGTT TGTGCTGCTGTCATACGGTTCCTGTGTTC AGTCCCTAGCTACCATGTG | 8.43E-06 | 0.017920236 | 1.69E-05 |
| 676 | 3570164 | 1 | | ACAACCATTGCTGACCCAGGCTTGAGGA AGCGGCAGCTGGATCCCAGAAAGGATGT GGTCCTGCTACTGCCGCTGTTCCTCAACA TGACTCACCCTGTGATGCAACAGTTCGT CCTGGCAG | 0.000742232 | 0.007613108 | 4.51E-06 |
| 729 | 3571068 | 4 | DPF3 | CTGGTTTTTAGCCTGTCGTGGAAGTGCTG GGACAGAAGCAGCCCCTTCTTCTCTCAC TCCCCGGCTGCCCCTCCTAGCCCCTCTTC AGGGGGTCCCCATGTCTCAGCCCGAGGG AGAAGTTGGCTCTGGCCAGAGCCACGCT CACACTCCCACAGGATGCCGCAAGTCCC AGGCCT | 0.003217076 | 0.00842338 | 9.64E-06 |
| 1293 | 3571928 | 2 | NPC2 | AACAACATTAACTTGTGGCCTCTTTCTAC ACCTGGAAATTTA | 1.42E-05 | 0.014150671 | 1.02E-05 |
| 1756 | 3572106 | 5 | YLPM1 | GCCCATGAATCTCATCGGCTTTATCATGA AAGTTTATTGTTTTTAATCCTAGTACAAT CAGCTACCAGTTACATACAGTAAAAAAC AGAAACAGCCACAAAGCAATGATGATA GAGATAGTCTGTGACATTGTACAGTGGA GGAAATACTCTCTGTTGGAATCCTCCAG CAGACCCCGCCTGGCTTCAGCAGTTAA GCTATCACTCCCTCCCTCCCCAAAACAGT | 0.001143679 | 0.008301208 | 6.42E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1167 | 3572167 | 2 | RPS6KL1 | TAAAAGAAAAATTAACGTCTTGCTTGGG TACAGCA CCCTATCTTGTGATTTCAGACTTGGGAGA GCAAAAGGGAGGGGAAGAAAATAAGAG TAATGGGGGGAGGAAGGAATGCATGGG TCTGCCCCTTAGAGCAAGTCTGAAACCA GAATCAAGAGTCCTCCTCCCCAGTGGGC CTGTGTGGGGAAGAGGGGCAGCCTGCC CCAGGGGTGCAAGAGGACAGCAATTCA GCTTCCAGGCAAAGCAGTTTAGA | 0.011762838 | 0.006906632 | 3.92E-06 |
| 978 | 3575711 | 1 | | CACTCCCTACCCTGATGTTGACAAGTGC AGCTTGTTTTAAAACTGGGCGCTGCATTT TACATGGAAAAGATTTTATTTTGAAATCT AGGGTGGAGTAAAACTCCAGCCAGTGAA GACTTGCCATGTGCTGTG | 0.046404092 | 0.008276865 | 7.07E-06 |
| 755 | 3576107 | 1 | | CGGGGTCTGCGAGGAGGACGTTCATGGG CGAGTGTGTGGTGGTGGGTGAACTGCGG CAGAACCCGAGATTAACAGCTGGAAC | 0.000579253 | 0.007787951 | 3.24E-06 |
| 1275 | 3576442 | 2 | CCDC88C | CTGTCTCGTGGTTGAGCTCGCAAACCTG AAAACTACTGACGCGCCTTCCGACTCTC ACGGCCTTTTCTCTTGCTTGCCTGCGGTG CCAGGAGAGGGTTTGGAATGAGGAAAG GGGTTCCCACGCATTTCTGCTGTTTGTTC TGTGAATGGAAACACTGTGCCAAGCCCC AAGAGGATTACGCTTCCAGGTGTGTAAC GTGTTTTCTGTGTCTGCCGCTTCCAGCAG CTGATATCTTTGGAACAAATAATCCACG TCAGCATGGGGACCAATTAGGATGCAAT GACAAACTGACTTCCCCCAAAGCAGACA CTACTCCAGTATGTCCCAGTAGAACACT CATTTGCAATGTGTTGAGCTCCGTTAAGC ACACACACACTCACACAACAGGCTTACG AGGCTCAGGCCTGGCGGGTCAGAAAGCC CACTCCCTCTCCCAAGGCCACTGGATCC CAGGAGAAGCCCAGACTGGCGATACTAC AAAGGTCTCCAGGGCCTGGCAGACCCCA GAGTCAGGCCTGCTGTTAAAAAGTGAGA GTGCTGCTGTTCCATTCCTGGGGTCCCAA GCACTTCCCTTTACCCCAGGACCCAGGG CAGCCTGCAGGGCAGCTGGCGGTGGCCT TGGCCATTTGCCCCCAGCCTCCAGCTGG CTCCTGAGCTCTGCACCAGGGGTTTGG GGACCACACAGGCACCTGCCTTCCTAGA TTTCCCTGGCTCACTTTTCTGCAAACACT GGATCTGCCAGGCCTGGGGATTGGGGGG CAGGAAAGAGGCCCCCATCCAGCCCCCT CCAGGCCAGTGTGCACAGTGCACCGAGG GGTCATCCGCACAGAGCGAGGTGCAAGC TCGATGTGTAACCTGGCTGCGGCACCCG ACATCCCCGGTCTCGGGGTGTTGATTTAT TTCTGAATAACTTTTTGGGTATAGAAACC AATTTTTTTTAATATATGACATGTATATG TACACACTCATGTGAAATATGTATACTTT GGGGGGATCTATTTATGTTCCAGTGGGA GTCACTCTCTTCTGTCGGGAA | 0.000894351 | 0.006736738 | 4.90E-06 |
| 1580 | 3576864 | 4 | TRIP11 | TGGGGAGCTACCGAAATCCATTTTACCG CTTTACGTTCCCCATGCCATAAAGGTGC ATCAGTGAGACAGCTTTGGGGATAGAAA TGAAAGGGCTTCTTTATGTGTGGGGGAA AGCATGGGACCTTGAGGGCAGTCAGAAG CACAGAAGGGCTGGATAACTATGGGAA ATGACTGGTCGCTCCTTGTATCCTAGATA GGGGAAAACGGTTGGCTGTTCCTTAGAC CCTAAGC | 0.002951948 | 0.006832084 | 5.69E-06 |
| 1828 | 3577079 | 2 | LGMN | AGAAGTCTCCGCTGCTCGGGCCCTCCTG GGGGAGCCCCGCTCCAGGGCTCGCTCCA GGACCTTCTTCACAAGATGACTTGCTCG CTGTTACCTGCTTCCCCAGTCTTTTCTGA AAAACTACAAATTAGGGTGGGAAAAGCT CTGTATTGAGAAGGGTCATATTTGCTTTC | 2.67E-05 | 0.009777743 | 6.33E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | TAGGAGGTTTGTTGTTTTGCCTGTTAGTT TTGAGGAGCAGGAAGCTCATGGGGGCTT CTGTAGCCCCTCTCAAAAGGAGTCTTTAT TCTGAGAATTTGAAGCTGAAACCTCTTT AAATCTTCAGAATGATTTTATTGAAGAG GGCCGCAAGCCCCAAATGGAAAACTGTT TTTAGAAAATATGATGATTTTTGATTGCT TTTGTATTTAATTCTGCAGGTGTTCAAGT CTTAAAAAATA | | | |
| 941 | 3577685 | 2 | SERPINA9 | TTCCAAGGCTCAATCACCAAACCATCAA CAGGGACCCCAGTCACAAGCCAACACCC ATTAACCCCAGTCAGTGCCCTTTTCCACA AATTCTCCCAG | 0.047746878 | 0.009206783 | 9.30E-06 |
| 1818 | 3579555 | 9 | WARS | GATCGGCTATCCTAAACCAGCCCTGCTG CACTCCACCTTCTTCCCAGCCCTGCAGGG CGCCCAGACCAAAATGAGTGCCAGCGAC CCCAACTCCTCCATCTTCCTCACCGACAC G | 0.004639335 | 0.006620066 | 5.48E-06 |
| 1710 | 3580123 | 6 | | CTGGGGATTGGCTTTGGCTAGATTTTCTA TTTTAACCCATGCTTCTTCCCGTTCTTTC ATTT | 0.000674778 | 0.008482164 | 4.73E-06 |
| 514 | 3580457 | 8 | TRAF3 | AGGGCTGACATTCCAAGACTGTAACTCT AAGGAACACAAGTCCTTCATAACCAGCA AGGATCCCACTCCCTCTATAAAAGCCT GCCAGGAGGCCAAGCCAGGAGCGTAAG CCACTGATAGGGCTGTGTCTC | 0.002404431 | 0.00816779 | 3.06E-06 |
| 208 | 3581157 | 9 | AKT1 | TGAACGAGTTTGAGTACCTGAAGCTGCT GGGCAAGGGCACTTTCGGCAAGGTGATC CTGGTGA | 9.72E-07 | 0.017106987 | 1.81E-05 |
| 1846 | 3584519 | 4 | SNRPN; SNORD108 | GATCCAGGCAGTTAGCGATATGTTGGAT GAATTGAGAAAAATGAGTTTTTCCTTTCC TACTAACTGAATTAGATTAGAAATAAGC AGTTAAGTGAGAAAAATAGGGAATTAGT GCCAGATATGTTGAGGTGTAGTGTTGAC AGGGGGTCTTTTACCTTCAGATGTTTGGT GCAACTTAGAGAATGCAGTGGTAGTTGC TGGCCCAGCCCATCCAAACAACCTCATT TGTGGGGTGATACTTCACAGATGACTTA AAATAAATCCCCTGAAAATAAGAATCTC TGGAAGAGATGACACGTGTATGTGCGTG TGTGCACGTGTGTGCGTGTGTGCACGTG TGTGTGTGTGTGTTTTGGTGGAGTGGT AGGAGGAGGGTTGGCTTAATGATGAGAA TCATTATTTCTTGAATTGGATGACACTTT CCATTCCTGCAAAGGGAGCGTG | 0.005336831 | 0.006734131 | 8.20E-06 |
| 1894 | 3587051 | 6 | | CCATTGGTGGAGCTTCTCTGGAATCATTT GCCAAAAGCCCAAGGCAGAATCCAAGG GTCCAAGACCATTTCCATGGAGCTCATG TTTTTCTTTTCTGTAGGAACTTTTTTTAA CCAGCACCCACCATAATTCCGAAGGCCA CGTTTCATCTTTCCTGGATCACTACAGTG AAGTATTACAGTTGTACAGTTCCCAGTCT GGC | 0.000483071 | 0.006821996 | 2.71E-06 |
| 1853 | 3588099 | 2 | TMEM85 | CTCCATGGTGGGGTGACAGGTCCTAGAA GGACAATGTGCATATTACGACAAACACA AAGAAACTATACCATAACCCAAGGCTGA AAATAATGTAGAAAACTTTATTTTTGTTT CCAGTACAGAGCAAAACAACAACAAAA AAACATAACTATGTAAACAAGAGAATAA CTGCTGCTAAATCAAGAACTGTTGCAGC ATC | 0.000587911 | 0.00910916 | 9.28E-06 |
| 493 | 3590406 | 9 | NUSAP1 | AGCAACGGAAGAAACGCGAGCAAGAAC GAAAGGAGAAGAAAGCAAAGGTTTTGG GAATGCGAAGGGGCCTCATTTTGGCTGA AGAT | 5.35E-07 | 0.018890824 | 2.23E-05 |
| 1073 | 3590434 | 9 | RTF1 | CATCCCACAACAAGGAACGGCGTTCCAA GCGGGATGAGAAACTAGACAAGAAATC TCAAGCCATGGAGGAGCTAAAAGCAGA GCGAGAAAAACGAAAGA | 0.002874523 | 0.01035944 | 1.38E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1272 | 3591735 | 4 | WDR76 | GGAAGCCAAGAGATGAGTTTCAAGGATG GGAGGTTGACAGAGCCTTTTGCAGAGAA GTTAAAAGAATGGAGAAAAGGCCATTG ATTTTGAAAATAGGGTACCATGTAGTGA GTTGAGAGAATAGCTTTGACA | 6.02E-05 | 0.010372129 | 5.14E-06 |
| 141 | 3594180 | 1 | | GAGCAGGCGGCTCAGACTCTTCCAACAT CAACTCCTGTTGCTTTGCCTCCTCTCCCT CATTCTACAACTATGGCTTCTTGGGATGC TGCCTATGTCCAGTTGACTGAGGGAGAA AAACCTCCAGCCTGGATTATAGATGGGT CTGTATGATGTGCTGGTACCACATGAAA GAGAACAGCTGCAGTATTCACTCACACT CACTCAGGGGTGACTGTGAAGGGCAGTG GTGAAGGAGAATCCTTCCAGTGAGCAGA AACTCAAGGCTGTCCACTATGTCTGGAG TGAGAGATGGCCAGAATACAGACCTAAA TTGATTCATGGACAGTCGCTGATGGTTTA GCTGGATGGTCAGGGCCTTAAAAAGAAC AGGACTGGAAGATTGGTGACAAGAAAA TCTTGGAAAGAGATATGTGGCTGAATCC CTCCGAATGGGCAGACTGAAGATATCTG CATCTCACCTGAATGCCCACCAAAGGGC ATCCACTGCAGAGAAGACCCTGAATCAG ATGGACAGAATTACATGCTCTGTGGCTG TCAGCCAGCCTCTCTATGCAGCTGCTGTG GTGTCTGCTCAACGGGCCGATGAACAAA GAGCTCTTGGCAGCAGGGACAGAGGATA TGTATGGGTCCAACAACATGGAATTCTC CCTCCAAAGGCTGA | 0.020503158 | 0.019553702 | 2.88E-05 |
| 471 | 3595274 | 3 | AC016525.1 | TGGGGCCCACGAACATCCCAGTGTGGCC CTGGACGGGACATCATGCTGGGCAACAC AGCTAAAATGCGGGTGAAGACCAGATTT CTTGCACATGGCGGTGACGGGATGCTCC CTAGAGAGCTT | 0.006090929 | 0.010571349 | 1.04E-05 |
| 1106 | 3595459 | 9 | GCOM1; AC090651.1; GRINL1A | AAGCCAATGCTGAGGTGATGCGAGAGAT GACCAAGAAGCTGTACAGCCAGTATGAG GA | 0.000540412 | 0.00953604 | 8.67E-06 |
| 2083 | 3596392 | 6 | | GCCAGGCAATGCTTAGGCAACTAAAATG AGGTTGGGGGTAATGCTAACGTCACCCT CACAGGGATGGCCACGGGACTGTTATT CGCAAGCTGGTTTTCTAGACCTGTTAGCT GG | 0.00360478 | 0.006859042 | 4.20E-06 |
| 1128 | 3597927 | 4 | SNX22 | AAGTCAAAGCCCTAGCCCGCGCTTGGCC CCTGCTGCCCCCTAGTGGCCATATGCTA GGAGGCAGGCCTGCTGCCTGGGCCTGTC TGGCCTGGGCCCTGAAGTCTGTTTTCCCT TTGGTGCCTCCTGAGCCCATTTCCCACTC ACCTTTTCCTTCATGGGTCCCTGGTGATG GCAACCCCGTCTCCACCCCTCTGTGGGA TTCTGCCCTGCCTCCCGCACCCATGGTTC ATGACCCTGTTT | 0.005236373 | 0.009698804 | 7.02E-06 |
| 771 | 3598798 | 9 | SMAD6 | CTGTCCGATTCCACATTGTCTTACACTGA AACGGAGGCTACCAACTCCCTCATCACT GCTCCGGGTGAATTC | 0.0079631 | 0.013209737 | 1.11E-05 |
| 950 | 3598809 | 4 | SMAD6 | GGGCCACTGCCGTGTTGAAGAATCACCA CCAGTTTGAGGATCCAGCAGAAATTTCT GTTTGTTCACAGGACGGTGCCAGGCAGG TTCTCATGGACTCAC | 7.32E-06 | 0.013268823 | 5.23E-06 |
| 658 | 3600663 | 5 | PKM2 | AGGGAAAGAGCCTCCACGACTCCTCCAG ACGCTCAGTCCAGGGCCGCCAGGGTCAG CCACCCTCCCCGCTGTCTCTATCTGTGGC CCTGCCACCAGTCACTCAACCCGACTTTT TGGTCTAGAGTAAGAGCAGCAGCTGTAC CCCAATGGCACAGCAAAGCAAATCCCCC TACAGGCACCATGCAAGGCCACAGACAGG CAGCTCAGTGAAGGCAACAGACTCCAGT GCAGGTCCACAAGGGCCCCCTGCGGGAG CGCCTGTCTGCAGGATGCGGGGCAGAGG GAACTGAATTGGAAGCCAAAGGAAGAG GGCAGCTGGGAGCAGGAGCCCCTAGCCC | 6.11E-05 | 0.006935628 | 3.53E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | TTTTCAGAATAGGGCAAAGGTACTCAGA ACTTCTGACTCTGAGGAAGAGGTACAAG ACCTCCTTTCACTGCAGAAGTATCCCAG GACTTAAGCCATGGGAAGAATTCACAAC CTTGAAGTCAGAAGTGAAATAAACTGTG TGGTGTCCAATGAAGG | | | |
| 691 | 3600707 | 7 | CELF6 | GCACCACCATTGATCAGCTTTATATGGC ACCCACTGTATACAACAGACAGACAAAG ACAGACAGACAGAGCACACACCACTTCT AAGCTCAACACTGCTCACCAACTAGAAG CACCTCGGTTAAGCACATGTGAGACACT CTTGCATAGGAAAG | 0.005817181 | 0.008292249 | 4.96E-06 |
| 1265 | 3602135 | 9 | C15orf39 | ATGCCATGCCAAGGACCAACTTCCACAG CTCTGTGGCCTTCATGTTCCGAAAGTTCA AGATCCT | 0.000348767 | 0.008774654 | 6.01E-06 |
| 300 | 3602538 | 9 | FBXO22 | AAGAACTAGTATGGAAACAGCACTTGCC CTTGAGAAGCTATTCCCCAAACAATGCC AAGTCCTTGGGATT | 0.000271873 | 0.010327297 | 4.23E-06 |
| 2024 | 3605298 | 6 | | TGGTTAAGGGCAACTTCATGCAACCAAA TAACATGAAATTAAATCAGTAACTTTTA AAAAAGGCTAAAATGTCTTTTCCCCCCG AAACACAACAGAGAGGAATATGAATAA TGTACATACAAACTGGGGTTCTGTCAAT GACAACAAGGACTATGTGTTGGTTCATA TCAAATCCAAGAATATTAGACAACCAAA CATATAACCTTCTTGTGGTTTCTCTTAAT ATGCAGC | 0.000516748 | 0.007297057 | 4.19E-06 |
| 531 | 3606365 | 9 | AKAP13 | CGTTCTAGGTTTGCCAGTGGCTCTACAG GACAAAGCTGTGACTGACCCACAGGGAG TTGGAACCCCAGAGATGATACCTCTTGA TTGGGAGAAAGGGAAGCTGGAGGGAGC AGACCACAGCTGTACCATGGGTGACGCT GAGGAAGCCCAAATAGACGATGAAGCA CATCCTGTCCTACTGCAGCCTGTTGCCAA GGAGCTCCCCACAGACATGGAGCTCTCA GCCCATGATGATGGGGCCCCAGCTGGTG TGAGGGAAGTCATGCGAGCCCCGCCTTC AGGCAGGGAAAGGAGCACTCCCTCTCTA CCTTGCATGGTCTCTGCCCAGGACGCAC CTCTGCCTAAGGGGGCAGACTTGATAGA GGAGGCTGCCAGCCGTATAGTGGATGCT GTCATCGAACAAGTCAAGGCCGCTGGAG CACTGCTTACTGAGGGGAGGCCTGTCA CATGTCACTGTCCAGCCCTGAGTTGGGT CCTCTCACTAA | 0.011925564 | 0.014048446 | 1.47E-05 |
| 789 | 3606371 | 4 | AKAP13 | TCTGACTACTTAACTCTTCTCCGTGGTGC TCTGACAAACTTGCCT | 0.000562297 | 0.008998609 | 4.54E-06 |
| 689 | 3606507 | 8 | KLHL25 | CCCACGTGCTCAAGTTGTTTCCAGATAC AGAGGCTGGGTTCGGCGACTGAGAAGGC CC | 0.001268815 | 0.008091689 | 3.62E-06 |
| 1567 | 3607176 | 1 | | ACTCCACGTACCCTTATCCTTCATCCTCC AACAGAACCAAGCAATGCGTGGTGCCCT GTACTCCCAGCTTGGTGCATAGCTCCATC CCT | 0.03244577 | 0.006957836 | 8.45E-06 |
| 1962 | 3607875 | 4 | ZNF710 | ACCTGAAGGGCCTACAGATGGATTCATT TCTCTATAATTCTTAGCTTGCAGTTTTGA CAACCAGAACCTAAACCCACATAAGAGC CTGCCAATGACCACAGATTCTCAGAGGA ACCTTTTTTTTAAAACTCCACCCACAGCT AACACTAAGATTACTTCCTTCCTGAATAC ATATCACCAGACGCTCTCCTTTGTCCCAT TGTCGCTATATTGCCAAATGCCTTCTCTC GATTTTTGGTCAAAGTCCTAATCATTTCA GGTCCAATTAAAAACTCAGTATCTCTTG AGCCTTCCCCACACCATATGTGCAAAA TTATCTGGTCTTTCCACATTCACAGCGTT CACAGGCCACTGTTGCATTACCTATTAGT CTGTGAGTGTACACGTTCGGACCC | 0.002887295 | 0.00824511 | 3.71E-06 |
| 1122 | 3608291 | 9 | CRTC3 | AGCACCAGCCTGTTCAAAGACCTCAACA GTGCGCTGGCAGGCCTGCCTGAGGTCAG | 7.71E-05 | 0.006560753 | 1.92E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CCTGAACGTGGACACTCCATTTCCACTG GAAGAGGAGCTGCAGATTGAACCCCTGA GCCTGGACGGACTCAACATGTTAAGTGA CTCCAGCATGGGCCTGCTGGACCCCTCT GTTGAAGAGACGTTTCGAGCTGACAGAC TG | | | |
| 1051 | 3608380 | 1 | | ATGCTTGTCCCAGTCCTGATCCTAAGCCC CTGCCTCGTTGG | 1.52E-05 | 0.014679978 | 1.04E-05 |
| 171 | 3608542 | 9 | AC068831.1; UNC45A | AGATCTTCCGGAGTAATGGGGTTCAGCT CTTGCAACGTTTACTGGACATGGGAGAG ACTGACCTCATGCTGGCGGCTCTGCGTA CGCTGGTTGGCATTTG | 0.024147101 | 0.014062914 | 1.15E-05 |
| 308 | 3609034 | 1 | | TTGTCCTGCCTCCTAAATATCAAGAAGG CAAGGAGGAGGCCACACAAAGAAGCCC AGCTCCATGTCCTGATGATCGCATCAAA ATTGTGGTCACGTTTGCCAGAATAGAGG CTACGCGATGGCGC | 0.00809385 | 0.008166242 | 6.40E-06 |
| 1409 | 3610580 | 1 | | AGAAGTCCACTTGGCTCTATCCTGGGTC CTGAAGGAGAAGCAAGAAGAAGGTCTT CGCAGGGAAGTCTCTGCTCAAAGCAAAA TCTCTTTATGGAATGGCATGAGCTATCTC ATTATTAAATTCACCAGCAGCCA | 0.018126 | 0.008073478 | 3.34E-06 |
| 461 | 3610850 | 4 | IGF1R | ACAGCCGTGAAGAGGCAATTTTCTCCTC GAAGGAAGGAACTGGAATGATTGGTTGT ATAATTGCAGAATTGTTTTCAGTATGTCA GCAAGCACTGAAAATGGGGAAACTGTCC CTTCCTACCTCTGTAGGCTGGAGACCTCG GGTTCAGCTCCATTTATCAGGGCACAGG ACCTTCCTGTTCTGAGACTTTGTTCCAGG GGACTTTCACACTTCAGAGAATAGCACA TGTCATCCTGCACTTTTGTGGGGTGATTA AAAGCTCACGGTATCCTTTTATGTTTAGC CCATCCAATTCTTCCAACTGGCCTCAGCC AGAAAAGCAGGGAAGGCACCCCCAGTTT GCAGCTGAGAGACTCCAGCCTGGGAGAG CTGAATAAATCTTTTGCCCAGAGGGGTT CCTCAGTAAATGCTGGAGATGAGGCTCA GACCTGACCTTTGGATTCCCAGATG | 0.000115329 | 0.011783696 | 6.89E-06 |
| 1480 | 3613297 | 5 | CYFIP1 | GGCTCTTGACGACCTTCAGCAGCTCCTCC ATGACCACGGCGATACCCTGGTAGCCGA GAAGCCGGCAGATGACTTGAAAGTGTGG AGGTCCCACGAAGTTCCGGTAGCTGCCG TAAATGCTGGAGTAGGCCAAGTTCAAAG CCTGGAAAACAGGGCACAGAGCTCTCAG CATGGTCCCCGCACACATGTGCAGATGA AGAACTGTGTGAGAAGATCACTCAACAC ACACAGGCTCAGGTGAGCGGGTCTGAGT CTACTGACTTGTA | 0.000338249 | 0.007322941 | 3.43E-06 |
| 433 | 3615994 | 9 | MTMR10 | ACGGTGTTATTCTGCCACGTGTCTCTGGA ACACACATAAAACTGTGGAAACTGTGCT ACTTCCGCTGGGTTCCCGAGGCCCAGAT CAGCCTGGGTGGCTCCATCACAGCCTTT CACAAGCTCTCCCTCCTGGCTGATGAAG TCGACGTACTGAGCAGGATGCTGCGGCA ACAGCGCAGTGGCCCCCTGGAGGCCTGC TATGGGGAGCTGGGCCAGAGCAGGATGT ACTTCAACGCCAGCGGC | 0.032789863 | 0.012174049 | 9.65E-06 |
| 472 | 3619652 | 9 | DNAJC17 | CGGCAACAGCTGATCGCACGGATGCAGC AGGAAGACC | 0.020051318 | 0.007567661 | 2.83E-06 |
| 1335 | 3619970 | 5 | TYRO3 | CTGATATGGCAAGGAATGCTGTCTCAAG AGAAGATGCCAGCGGGTGGCCGCTGTCC TGGCCTGTGGCTCTTCCCTGCTCCCTTCA CCCTCTCAGGACCAGTCACAGGATGGGG GCCAGCCTCCCGCTCCCTATATGCCCATC AGTCCCCGAGGTGCGGGGTGGGAACTTG GAGAGCACCGTGCTGCATGGAACGCTCT TGTCACCAGCAAATGCCTCAGTGGCTAT GTGGGAACACAA | 0.024995647 | 0.007527987 | 5.58E-06 |
| 408 | 3622256 | 9 | DUOXA1 | TTCTGGCTGCTTCGGGTGGTGACCAGCTT ATTCATCGGGGCTGCAATC | 0.001111606 | 0.013225165 | 8.44E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1685 | 3623298 | 6 | | AGGTGTGTTCCTTATGTCCGGTCTATTCT GTAATCTCATTTTGGTTGCTGTTACTGTG GAAAATCCTGCCTCACAAAGATAGGATG TTGAAAATGGAAGGAGGCTTTTCAGTAC TTTTGTGGCAATCTCAGGATGTTCCGCCT TGACTTTAATCGAGAACGTATGGAGATT TGAAGTTGTCTCAAACATACTTTTAAGG CCACCGTCATTTGCAATATCAAGCAGTT GATCCTCTTCTAGCGTGGACAAAGTGGA TTCACCTGGCTTATTCACAAATGGGTCAC AGATCCATTCCGTCTTTT | 0.001201893 | 0.008487235 | 4.64E-06 |
| 1201 | 3624150 | 9 | DMXL2 | GTTTCACGTGCCACGATCATGGTGCCAC GGTACTGCAGTATGCACCCAAACAGCAA CTCCTAATCTCGGGGGGTAGGAAAGGAC ACGTCTGCATTTTTGA | 0.000113163 | 0.008737126 | 3.53E-06 |
| 603 | 3625209 | 1 | | ACCAGCTACAGGTGGAATGCCCAAGTGT GCGAGAGAGCAGCTTGGATGGCATAATG GATATGGTGGTTGGCTCCTCGATGGCAT CTCTACCATTCCTAATGCGGTTTGAAAAT TGTGCTCAGC | 0.000909538 | 0.009521061 | 6.84E-06 |
| 1355 | 3626324 | 9 | ALDH1A2 | GAGAATTTGGCTTGCGGGAGTACTCAGA AGTTA | 0.006363163 | 0.006967527 | 5.37E-06 |
| 329 | 3626947 | 4 | MYO1E | TGGGTGTCCTTCCATCATGTCCAAGTCTT AGATCAGTTTCTAGATCTAGGCTCAACA AAATTCCCTCCCCTGGACCCCCAAGCCTT CCCAGATAGTCACCTTCCTCTTCCATATG TCCATGGCACCTAGTTTGAAATGTTCTTA CCTCATGCATCATGTTCTGCCTTGTGTTA GACCCTTTAAGCTTTTGTGTCTCATTAAG ATATTGAACTCGGCTGCGTGC | 0.000165213 | 0.012396011 | 8.86E-06 |
| 1297 | 3629800 | 5 | SLC24A1 | GGATCCTTAGACTCACCAATAACTGAAG CTACAGTGATTACAAACCTGATAGAACC TCACAATTTGAACAGAAAAGGAGGAGA CAAAATTGCAGCGTGTGTTTGGGGCAGA GGTCAGGAAGGCTGAGATGTAGACCACA TCTGCATCTTTTGGGCCAGCAGCCTTTGG AATGATCAGGGAACAGTGAGCGTAGGA GCTTGTCTTATAGCTGCTGCGCCTATCCC AACCTTTGCCCCCAGTTATCTCATTTAGA AAACCCTCTGGCTCCAGGGGTCCTTCTA CTGCCTCCATGTAATAGATGTCTGCATG AGTCAGGGGTAGAAACTCCACCCCTCCA GGGGTGAGGTTCTTAATCCACAATGAGC TGCAGGTGTTTCCAAGGACAAACTTTAG TCTCAGATCACATTCATATCAGAGGTCCT AGGTCACCCAGTTCACTTTCCAGGATCA TATACATTCTTTCATTAGGGTCACAAGA GATACAGTAACTTCTGCATGGTCTTCTGA TCCATGCCCATTGTG | 0.00241526 | 0.007108487 | 5.22E-06 |
| 1649 | 3630807 | 4 | ITGA11 | ACTGCCACCGTGATGCCATCAGATGGGA GAAAACACAGAACTCGGGATGAAACGT CACACGGTCTGGGCTAAAGATCTTGCTC TTTAATTTCCCAGCAGGTAACCITGTGGC AGTCAC | 0.043006584 | 0.007070619 | 3.20E-06 |
| 800 | 3631715 | 5 | THSD4 | CAAAGACTCTACCTGCTGTTGTTAAGCA TGAGGTTTATCCCCAGACTACA | 0.002350957 | 0.008460984 | 5.38E-06 |
| 1881 | 3631998 | 9 | PKM2 | CAAGATTATCAGCAAAATCGAGAATCAT GA | 1.77E-05 | 0.008339926 | 7.97E-06 |
| 1707 | 3633108 | 7 | CSK | GTCCTCATGGCGTGGTTTATTACAATTCC ATCTCACAAGGCGGGTGGGCGGGTGGCA GCGGCACACGAAATCCAAGCCCCTGACA GACGTCTGCCTCGGGCGCATGCAAACAG TGCAAC | 0.00010346 | 0.006803205 | 1.99E-06 |
| 281 | 3633239 | 2 | RPP25 | CACCCCCACCGTTGACAGAGGAAGGCAG GGGGTGAGAATTAACTGCTTGAGGGTAG GAGAGTCTGAGATGTGGGGGCCCTATTC CGCTCCC | 0.004749446 | 0.011305801 | 9.00E-06 |
| 701 | 3633468 | 2 | PTPN9 | TAGAGATCGTCCTGAGTGCCAAGCACGT TTATAAGTAGGGCGTGTATTCCAGTCCTT TCTGTCATTCTGTGTGTGTGTGTGTGTGC | 8.24E-05 | 0.01263796 | 9.39E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | ACTTATGTGTATGGGTCCATATGTACGTG TGTATATAATATATATTGTATGTGATAAT ATGATCGTATTCTATAAATACATATACA CACGATACTCCTTTCCAGAAGTTCCTGG GGCTCCGTGTTGCAGTTCAGGACTCCTTG CTTCTTGGACCCTACTATTTATCCTGGAC TAGCTTGGGTTGGTGATCATGTCTCCTCT TGTCAGGCTACAGAGTGGTGGAAGAGGA CACACACACATCTCCTCCATGTTCCTGCC ACAGGGCCCCTTCCTTAAGTAATGACTT ATCTCCTTCCAGTTGCCACCTGTTGGAGC CAAGAATGTATTAGTTTGTGGTGACACT GGGTTAGCTCAGCATGGATTTCCCTTATC CGATGATTTTCTACATTTACTTGGCCAA TTTGGGGAACAGACCTCCACTGTGATTC CATACTCTCTCTTTGCTTTCACTATCCCA GGGATGGGAGGCGGAGGGTAGAGATGA ACTCACTGAGCAGCCAGAGCCAAATGCA ATCGGTACGAATCTTAGAAGGAAGGAGG GGGAGCCCAGGTATGAGAAAGAAAAAA CCACTAAGAAAATACCTCCCTGGGAGGA TGAGCTGGGGCCCTTTTTCTTTTGCTGGA TGGTTCCTTTATGCAGCTTGGCCCTGTCT ACCGAGATGCCCATCTCTTCCTGCCTGCT AGCCTGCTAGACCCTCAAACTG | | | |
| 342 | 3633789 | 1 | | TGACTCTGGCTTCCGTCAAGAGCTGTCTT GGAAGGAGAAAGGAGCTCCTGAGTTGA ATTTCAGGTGGACACCCACCATGCTAAA TAGAATTCCAAGCCACTAGCCTCTAGCC ACACAGGTTCCATCCCAACACTCCTGTCT GTGGGACTTGATCTGAAAAGCCACACTT TGGTTGGGAACCTTGCCCAGGGCTGGCT GGAGAGGGGCCTGTTGTGCCACTCAGGG AAGGCCTTATGGTTCCCTCATCCTGGGTG GGCTTCAGGCTGGGGCTGCAGACTCTGG CCCAGCTCCCTGGTGGGCCAGTCACCAG CACTGCTGGCTCTGAGTCCTGATTTCTTA CTTTGGCTTTCCTGGTGGCACCTGGTTTG ATTCTGGACAGCTCATTTCACATCTAGCA TGGCATATAATCCAGCCAGACCTGGGTT TGAATCCTGCCACTACAGCTCACTAGTT AGCTGTGTGCCCTTGGGCAAGCCCTGA ATGAGTCATTCCATGGCTGCTGTTTTCTC CTCTGTAAAGCAGGGAAGATAGCGCCCA CTTTCCAGGGCTGTGCTAAGGAGGGAAG CCTGTGAAGAGCACCTGTCACAACAGGA AATGCAGACGTGGGAGTCACTATTGTTA CCACCCTCTTGTTCTAGCAGGAGACA | 0.031655198 | 0.010760075 | 1.29E-05 |
| 1785 | 3635006 | 1 | | GGCGAAGAGTGTCCTCGGCTCTCCTCTTC CCAGGGAGCACTCGGGGCTTCGGACTCT GCAGTGGTTTGCAAGGCCAGGGCCAAGT GGTCACTTCACTCACTGA | 0.007013144 | 0.007732766 | 5.49E-06 |
| 506 | 3636219 | 1 | | TGCCACTTAGGCATCCCTGAGCATGTCT GTTCATGGGTAAGATGGGGTG | 0.000487927 | 0.011230631 | 7.37E-06 |
| 530 | 3636467 | 3 | C15orf40 | CCAGGAGGCTGTATTCTGCTTTCTCCTCC CTTGCTTTGGCTGATCGCACCCCTTCTGT CAAGAATACAGCACTCCCATTTCCACCA TCTTTGTTTGGCCAACCCCAGTCCGTTTC TCAGACTCAGCTCAAGCACTGCCTCCTG CTGGCAGCATTCTCCAGTGCCCCAATGC TGATTTGCCTGTGGGGTAATGTTCTGTGC CTATCTCATCGGTGCACTTAGCACAGTGT ATTATAATTTTGTATGTTCTTTCTCCCTC GCAGCAGTCCGAGCTCCTTGAGAGCAAG GACCATGTACCTTTTCATCTTTACATATC CATTGCCTACATATTTGTTGAACGAAAG TTCCTAGCACAGCCCTGTCCCATAACA GGCCTTTAAATATCAAGCACTATTTTTTT TTCCTCCCTTTCCCGCAACATGCAGACAT ACACACTTTCACCAACATTTATTAGCTCC | 3.19E-05 | 0.012446094 | 6.72E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GACTGCATGAGATACAATGATGAATAAT AAATGATCCCTGCCCCCAAGGAATTGGA AATACAAAGCAGAGGGAGGAGCAAGCA TTAAGGTTTAGAAGCCAGAGTTAGGTTT TCTTGCAAGGGGGAAAAAACACTGTTG GGTTGATGGGAACCCTTCGTGGGAAAT TGAGTAGAGCCTTGAAGGTTGTGGGAAA AGCTTTCTAGGTGGCCAGAAGTCCCTGG ACACCACTGATGAGCCTAGTTTG | | | |
| 320 | 3636521 | 5 | TM6SF1 | GCTACTCTGAGTATTTGTTACAGCAGCA GAGCACATAGCCTATCCTTAGACAAATA GGTAAGTAAAACTTTTAACGTGGTTTGC CTGGCATGAAGTAAGGTAATGAGA | 7.74E-05 | 0.013827425 | 7.45E-06 |
| 1927 | 3636531 | 6 | | CATAGTCCTTGTTGTCATTGACAGAACCC CAGTTTGTATGTACATTATTCATATTCCT CTCTGTTGTGTTTCGGGGGGAAAAGACA TTTTAGCCTTTTTTAAAAGTTACTGATTT AATTTCATGTTATTTGGTTGCATGAAGTT GCCCTTAACCACTAAGGATTATCAAGAT TTTTGCGCAGACTTATACATGTCTAGGAT CCTTTTATCAAGGCAGTTATGATCATCGT TTTCCTGCCTTGACCCCACCATCATCAAA CACTCAGTTAAATATAAATTAACATTTTT TAGATGACCACTCAACATAATGCTTAAG AATGGAATTTCCTCTCTGTGACAGAACC CAGGAATTAATTCCTAAATACATAACGT TGGTATATTGAAGACGAAATTAAAATTG TCCTTCAGTTTTGAGGCCATGTGTAAAGT TTAACCA | 4.46E-05 | 0.006967514 | 2.72E-06 |
| 1955 | 3636534 | 9 | AC024270.1 | TGGAGATGCGGGCAACGACACAAGAAA CACA | 6.74E-06 | 0.008661601 | 7.98E-06 |
| 522 | 3639047 | 9 | PRC1 | TTCATGGAGTATGTGGCAGAACAATGGG AGATGCATCGATTGGAGAAAGAGA | 0.000293755 | 0.021280706 | 1.95E-05 |
| 123 | 3639054 | 9 | PRC1 | TGAGGGGCTGCGTACTCAAATCCGAGAG CTCTGGGACAGGTTGCAAATACCTGAAG AAGAAAGAGAAGCTGTGGCCACCATTAT GTCTGGGTCAAAGGCCAAGG | 0.010100664 | 0.025201383 | 3.68E-05 |
| 1923 | 3642244 | 4 | PCSK6 | TGAGGTACGCTTGGGCATTCCTGTTGCCT GCATGGTTCGGCATT | 0.00076237 | 0.006698636 | 2.18E-06 |
| 1486 | 3642303 | 9 | PCSK6 | CAGTCGCTGCCGGTCGGAAATGAATGTC CAGGCAGCGTGGAAGAGGGGCTACACA GG | 0.011398396 | 0.006563752 | 4.97E-06 |
| 935 | 3644067 | 4 | MAPK8IP3 | ACCTAGGTGGCCAGGCAATTGTGGGAAA TGGAAAGA | 0.014482591 | 0.006785207 | 4.01E-06 |
| 1142 | 3644647 | 9 | E4F1 | GACTTCACCCGTGATTCACCTGGTGACA GATGCCAAGGGCACCGTCATCCACGAAG TCCACGTCCAGATGCAGGAGCTGTCCCT GGGCATGAAAGCCCTGGCC | 0.012043037 | 0.009620411 | 8.84E-06 |
| 70 | 3645319 | 1 | | CTCAGGATGTCCACCAGAAACCAGGAGT CACCATCCTCTTAAGGGTGGTGCCTGTCC TCCAGAGAGCATATCACTGGGTTCAAAC CCCAGCTCCTACCGGCAAAGCCCGGGGC CTCCACCTGGGTGTTCCCATCCATGAAG CGGGGATACACAGTGTGGAGCCCTTGGG AGGTTGGGGAGTGTGCCTGCCCTCACCG CGCATCAGCTCATAAATACAACAACAGT TGCCTTCACGTGCTGATGCTC | 0.009940781 | 0.024791572 | 2.57E-05 |
| 306 | 3645476 | 2 | KREMEN2 | GCGAGATGGACACCTGAGATGCTGTGCT GCGCCCTGCCTCGGCCTTGCGCCTGTGTA GGGGCAGCTCGGCCTCTGGTCGCCTTGG GGAGACCAAAAGTCGGACAGGAAACAT CTGGTGCTATTATCTGGGACTTGGCCTGA CCGTGGGGTCCAGATGGTCCAGGCCCT CTCCATGGACCTGTATGTGGGGTGGTC TCTGGTTTCGGAGGTCTTTGAAC | 0.025777155 | 0.009389094 | 7.22E-06 |
| 341 | 3645652 | 1 | | CCAGTCACCGCGCACCCACCCTGACCCC TCCCTCAGCTGTCCTGTGCCCCGCCCTCT CCCGCACACTCAGTCCCCCTGCCTGGCA TTCCTGCCGCAGCTCTGACCTGGCGCTGT CGCCCTGGCATCTTAATAA | 0.022361426 | 0.016525847 | 1.46E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 552 | 3646448 | 9 | UBN1 | TAGAAAAGACCGAATACAGGACTTGATC GATATGGGTATGGTTATGATGAATCCG ACTCCTTCATCGATAACTCTGAGG | 0.000120755 | 0.016425661 | 1.61E-05 |
| 1680 | 3646802 | 4 | RBFOX1 | AAATGTCGTTAACATTAACAAGAGCTCT CTCTGGCACTGGCAGGGGGTCTGCAAAC AGAACTGGTTTGGAATATGCAATGGGAG GCTTGAATCAAAGAAAAGCTGTGATACA GACTGTGGAGTGTGTAAGACAAACTCGA TAA | 0.023281585 | 0.00682901 | 3.36E-06 |
| 1155 | 3649263 | 4 | BFAR | TAGGCAGGCCTGTGCAAACCTATCCCCT AAATCAGAGGAAGCTGAGGGGCTGAAG GAAGAAGCTGGCAAATTCAGTTTCTCAG AAAGAAACACTTAATAAGGCCTTGCCAA CAGAAGCCCTGTCTGTGTCTTGGATGGT AGCGAGACAAGATGGTGGATCCCCAGAC TCAGGGCTTGTATACATAGGGAAGGGGC ATACATGCTTCAGAAGGGATGTGCAGAA CAATTGCTTAGGGTCGGGATCTATGGTA AGTAAGAGAACATCAAGGCTGTTTCACC AAAGGGCAGGATTTACGTGATGTACGTG CTCTTACACAAGA | 5.94E-05 | 0.009644722 | 5.18E-06 |
| 2068 | 3650718 | 7 | ARL6IP1 | GCTACAATGGGCACCACTGTTCACAGCA ATATTAAAGAGGAGAAAACAACACTTAT TTAATAGGGACAGATATACCACAAGGTA CAACATCAGTGCAATAAATTCACAAAAC TATATTACAGCTAGTTAATCAGTTTAAG AATTGTTCCCGTCAGTCACATTTTTTGGC CCTCAGAAGTTCATTCCTAAAGATTTCA ACTACTCTAAATTTCTAGCTACCAAGAA GTTAAGAATGATTATAAGAAGCTTTCCA AGGAGTTATGAAATCTTTGTAGACCAGA GGCCAACTATCATCACCTCAAGTCTGCT CTCACCAACAGCCCTTGTATTTTTCAGGG AGAAATCTCTAGGAAAAAAGTCAGACAC CAGTGTAGTCACTATCTCCCATGTCAA | 0.000408197 | 0.008537529 | 6.97E-06 |
| 491 | 3650720 | 7 | ARL6IP1 | TGTCCTTTTGCCAGTCTTAGAGTGAAAGT CATAGACATGAGTCTTAACCTACTGTAT ACTATAGCTAATGTCAGCTGAAAATCTG AAATTAAAAGCATGCTAGAAATCCTAAA TGCAATCTTTTGGAAGTCTGCTATTAAAA AGCCTTTAAGGATTACTAACTTCGAGTC TAAGTGCAAGGGGACGAAAGCTTAAGCC TGTCAGACATTCCTTTTCTTGGACAAAAA GATCAAAGTTTCCTACAAATTGCTAAGC TTTGCACAAGGGAGAAGCCTACATGTAC TAGTGCATGGAATCAGTTTCATCTTATTT CATGGGGACTCTTCTCCCACTGGAAAGA AACAGAATGAGGAATGAATCTTAATTGG TCTCTTCATCAGAAGTGGTAAACTTGGTC TCTATATTCACGAAGTCAGACAGTTTTTT AAGCAGACTGTGGAAGCAGACAGAACC AGCTTCCTGTAGCCACAGACCACTACAT GGTATCTAAGCTAAAGCAAAGATGAACA ATTATCCAGATTCACTTGAACTGTACTAA AGGGCAAGGTTCACCACTACAAAAAGG A | 0.000397001 | 0.017872044 | 1.57E-05 |
| 2049 | 3650850 | 2 | ITPRIPL2 | TTTTGTGGCGAGACACCCTTTGGTAACTC CCACTGACCAGTCTTGGGAGCCTTCCTG GAATGATCGTGGGCTGAGCGGAGATGTT TTTTGCAAAATGAAACTGAAGCTGAAAG AAAGGAGAATTCGAGTGAACCAAGAGA AATCCAAAGACCTGGGGAAGGAGGACTT AAGATGAAAGTGAAGCAAGAGAGGGAA GGGGAAATGAAGTGAAAATGGCGTGAG GGTGTGAGAGAGGTTTGGGTTAGGAAAC ATGTTTTTAGTGCTATTTCCAACCAGGGG TCGCAAACTCAGCAGCCTGTAGAAACAG GGGTGGGAGGTGGGGGGGAAGCTGTGC CCACCCTTTAAAGAGGGGGCCATTGCTCA GCCATGCAGAAAAAAATGGGGCAACAA | 0.000563692 | 0.006746985 | 5.10E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GCTGGAAATCAGGTTTTTTTTTTAAAG TGAAACTTGATGATTTTTAAACAAGTAA TTAAAAAAATGTCCAAAACACCATGTGG GCCAAACATTTGTTTGAGCCTGGGGCC ACCAGTTTGCGACCACTGCCTTACGTAG TTAACACCCTGAGTATGTATACAGTCAT ATTTTTTGTTTTGGATATGGTAGTGTTAT ATATACTTGGGGCGTGATATTTGAAGT CATCTTTATCTCTCAGAGTTAAGCTTTAT TGTAGAAGAAAAAAAAAAAAGTTAACA CAGCCATAGATAACACTTAACTCACAGT TCCCAGGAGGACACTTGATCTCGAAGCT GCTCTTTTTGAGTCAGATCCTACATCAAA CCACTTAGGGCCAGTTTTTGGCATTTCCT TCCTGGTGATTTGGGGTAAACTTCTTTGC TCTGTCGGAGTTTGCAGATGAGTAATCA GAAGGATTGCAGAATAACTTGTTTCTTT GTATTTTATTCTTACATTTAAATTAATTT TGGGGGGTTAGTGGTATCCTAGCTCGTG CCTTTA | | | |
| 1336 | 3656881 | 1 | | AGGCCAAGAGCGGATGTTCTTCATTTCA CTT | 3.67E-05 | 0.007684195 | 2.95E-06 |
| 1276 | 3658909 | 5 | SHCBP1 | CAGCAGTGATTCTTAGGGCAGCATGTGC AAAATCCAGTATTTTGCTATCTACTTACA TCACTGTAGTCAGAAAAGAAATGTGCCA AAACTACCTTTCCCATTCCACTTGAACTG GTTCCCCACAATCCCAACAAACATCTCC TGTGACATTAAGTTGTCATCAGCTTGCGT GATCCCCAGTTCACTCAACCTTTTCTTCT TTATCTGGCCTTTCTGTGTGGAGGCAGCA ATTAGTTCATTTACAATTTCACAATTTCC CTCGACTTGCTCAGAAGGGTC | 0.000483071 | 0.010824915 | 7.91E-06 |
| 1482 | 3659265 | 1 | | TTTTGAGGCAGTTCAAGTGGAAAAAGAA | 0.024995647 | 0.006856396 | 6.12E-06 |
| 1133 | 3659928 | 1 | | AACAGTCCTTACTTATGCCTCCTTGCACC CCAGTGTTAA | 0.000457168 | 0.012434795 | 1.58E-05 |
| 1205 | 3662100 | 4 | MT3 | CCCGCTCGCATCCTGCGCACTGCGCGCC CTTGTACCTGCAAAGAAACCCACGCCCT GCGCCTTCGCTCAAGGACACTTGGGGGA AGGGCCCCTGATTCCCTATTCTTCACCTC GTGAAGGGCGGGCATG | 0.000203565 | 0.007595331 | 6.87E-07 |
| 705 | 3663746 | 1 | | GTGCGTAGATTGATGACATGGTCCCAGG TGAC | 0.040170313 | 0.010447485 | 7.74E-06 |
| 252 | 3665867 | 4 | NUTF2 | AGTGGGTAGGAGTCACTCCCATCAATGA AGAAATATCCTAGAAAGGGCCAGGTCAG GTAATCACCTGGCCTCGGGGAAGTAAAC TGCCCCCATGAGACTAAGGGATCACTTG C | 0.002293409 | 0.012252329 | 1.43E-05 |
| 1120 | 3667448 | 5 | HYDIN | TGGCTTTCCCTCTTACAATGGGTACTCAC TCTCCACAAAGGGTTATGCCCACAGGAC AAGAATGATACTGAAACACTACTTTGCT ATTTTACTTTCTTTACTTGGATCTCCTTTC CAACTTTCCCTTCAAGCATGTTGGGCCAT TTTGATCGCTGGTGAGCACATGTGAGTC GGGGAACCAGGGCAAAGGAAGCAGTAC TGGATCCTTTTCC | 0.00051035 | 0.007418618 | 2.56E-06 |
| 1623 | 3667557 | 1 | | TCTATCTCAGCTGCCGACTACAGGGCCC CCTGCTGTTTCCAGTTCCTGGCCCACCCA GAGTTTTTCCTACTCATGTGGGCTACCCC CAGGACACTGGGAGCGAGGCCCTTGTTT AAGGAATCGTCTTCAGCATCACGGCAGA | 0.003781407 | 0.006522573 | 2.35E-06 |
| 159 | 3668335 | 1 | | GTAGAACAGACACAACCGCAGATGCTGC TGGATGGAGGCTCCAGGCCCCTTTGGAT TCACTCTTCCCCCACCACAGACTGGTTCA GGTTGTCCAGACCAAGGTGCATAGGGGC TGGCCAGAGTGGTAGGTGGACAATGTCA TCTACTGGCTGCTAAGAATGTTATCCCTG TAGTTTGGGGCTGGTGTGGCTCAGTAAT CAAATGTGTGAGCTTCTTTGAAGTAAGA TGGCCCTGGGTTC | 0.006389661 | 0.018264551 | 2.24E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1177 | 3668759 | 5 | FA2H | CAAGGGAGGGCTCCGAAAAGGACATGGCGAAGTGGCAAAAAGA | 0.000165213 | 0.009488445 | 5.47E-06 |
| 1924 | 3671836 | 7 | COTL1 | CTGAGTGCAGAGATGTTCTTTACAATCCCAATACAGTACAGATTCTTCCCCAAAACGAAATGAGCAAGGAAAAACAGAAAAAGAGCTATATCAAATGTGCTCATGAAGAACCAAGCCAATCTCACCTTTCTTTAAAAACAAAACAAAACGATCCTTTTGAATGTGTGGTGCAGACGCAGGACTGAAGCCACAGGCTTTTGGGGTGCTGTGAGCCCAGGGCTTTGCTCAGCTCACAGCTAGCGCGGCGG | 2.19E-05 | 0.009188463 | 4.39E-06 |
| 46 | 3672375 | 1 | | GCATCCTGGTCTATCGAGTGGGTCATTGTGGTGGCTGCCGCCTACCTAACCAAACCTGGTCCCACGGGCCAGCTCTCACTGTGGGGCAGCCAGCTGGAGGGACGGGGCCAGCTTGCCCCACCCCGCCCCTCCCCTCCACAGCAGAGAGTGCCCTGGCTCCATGGGGCCCAGCACAAGCTCTGGAGGCCACAGGAGTGCCTCCCCTCCAGGGCCTGGCAAGGCTGGCTCTCTGCAGGGCTGGTCAGGTCAGCTGCCTTGATTTCCCTCTCCCAGGGGCCTGATGTCATCATTCAGGGGCAGCCTGGGGACTTGAGGGAGGATGCAGTTCCCACTGCCTTCTCCCGTCCTCCCCTCCCCTTCCCTTGCTTCTCCTTCTCCTTCCTGCTTCCACGTCCTGACCCCCTGGCCCTCCCCAGCCCGGCCCCTTAGCCTCCCCTCCCTCCCGGCCCCTCACTCCCCCCCTACCAGGGCTGCCCTGTGCTAGCGCCTGCCTGTGTGAATGTCTAATCTCCAATTTTATTCGCTGGGCTCCAGCCCATTTGCATAATCCACACAGTCACCCTGGTTTTAATTGCCCACAACTCTGCAGAAAGATCATGTGGTTAAGTGGTAAATCATAATTAGATAAATAATTGGTTTGGCCACAGCAAGCTGCTTTTGTTACACCTGCCATCTGCTGGACCCGTTTTTTCTTCTGGCCAGAACAATGCGGTTCTGATGACAGAGCATGCTGCTTCTCTCTTCTGGGGGGGCCGGAGGGGGCTGAATGGAGGGGCTCGGAAGCAGTGCCTGGAAAATTGCCCGGTTGCTGGGGTCCGCGCCTGGCCTGCGCTTCTTTCTCTCCAAGCGGGCACACCACACACTCGCCATTCATTACCCGGCTTGGTTAATGCATCAGAGTGGCAAATTTGACTTCTTTGCAGAAAAGGGAGGGAGGAAAGGGGCCTGGAGGAGGAGGGGGACCAGCCAGGGCTGCCCAAGGCCTGGCCTGCCTGCCGGTTGTCGGTGGCCCCGATGGGCCAGGGCAGGAGGCCTGCTGTGAGGGCCTGGGCCCGATCCCTGGGGGGTTGGGGGGGGGGGCGGAGGGGACAGGCGGGCAGGGGTTGGAACCGCCAGACCTCCCTGCCCCACCGCGGTCAGTTCTCCATCTGCTCTCCACCGAAGCCTCCTTTATTTTCCATGCCCCAGGCCCCATCTGTGAGCCCTGAGTCTCCAGGGGAATTGTGGCTCCCTGGCTGGACGGTCGCCTGGCCAGGGCCTTCCTTGGGGCTGCTGGCCTGCCTTTCATGCTGTCCTTCCAGCAAGCTCTTAGCTCCTAGACTTCAGGAACGGTTTCAAATTGTCCTTCCTTCACTCGCTCCCTCACGCATACACGCACACATTCATTCATTCAGCAAACGCCCGTGGAGCCTCTTCCTACATCAGAGTGCAGGTTCGAACTTGGTCTCCGTGGGTCAGATGGCCGCTGTGGGATGTGAGCAAGTTCTCAGCCTCTCAGAGCAGGTTCTTCCTCTGTAACACAGGAGTCATTATTGTCCCTGCCTTCTGGGCCTATTAGGAGGATCAAAGGACAGAATGTGGATAAAGTCTGTCGAGTGACACCTGCACGAAACACAGGCCCAGTGTCTGTGGCTGGTGAGTGCGTGACTGCTGGTCATGCCCG | 9.32E-08 | 0.068293918 | 8.00E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CTCCCGGGGAGGGCGCCAGCGCCGCTCA CCTTGGGCATCATTGGAGGCCCACGAGG CTGTGCTGAACATGCTGAAGGAAGAGGT ACCAGTGCCATGGGAAGGGCCCAGGAAT GAGGAGCCTTGGAAAGAAACCAGGGGG CCAGGGGAACAGGCAGAGGGGCGGTAA GGAAGGGCAGGTTCTCTGGGGCCTGCAC AGGCCAGGACGTTCCTGTCTCTGTTGAG TTCGGACTGGCAGGTTCTCTGGAGCCCA CACAGGCCAGGACGTTCCTGTCTCTGTT GAGTACAGACCGGCAGGTTCTCTGGGGC CCGCACAGGCTGGGACATTCCTGTCTCT CTCGAGTACAGACCAGCACATGGTCCTG CTCTCTGGCCCCTGCATCCCCTCCAGACT GCGTTCTGGAAGCCCTGCCCAGGCCTCA CACGCTGCCCCAAGGGTCTTTATTACCTG GGGTCTTCTAGCATTTTCCTCTGGAGAAA CTCAGGAAGCATCCTTTCTCTGCATCCTT TCTCTTTGGGGGCCCAGCTTCTCCTTTTC AGTTTGACAGACACAGCCTGAATGCCCA AGGCCCCTCTGCGGAGACTTAGAGACTT A | | | |
| 153 | 3672652 | 9 | FOXC2 | GGCTACCAGTGCAGCATGCGAGCGATGA GCCTGTACACCGGGGCCGAGC | 0.010386073 | 0.014074276 | 1.46E-05 |
| 1506 | 3672970 | 2 | JPH3 | TGAGATGTCGCGGTAGCAAAAATAGAGA AAGGGTAGAAAAAAGGGACATTAAAAT TAAAAGCAAAACCACAAGAAGGGAAAG ACCGCAACTCGGACAGCCCAGCGACTTC CAAGT | 0.004521888 | 0.007853911 | 3.53E-06 |
| 78 | 3673319 | 6 | | CACTAATATGCAGAACGTGGGGTCCACA GAGACGCAGATGCATCAACCAGAGAGC GAGAGAAGCGTCTCTGGAGCTGGGATAG GCCACTGTGTAAGATGCAAGGCTGGAGA GTGGGTATCTGCCAACCC | 0.011533849 | 0.025675715 | 3.77E-05 |
| 917 | 3675052 | 3 | AXIN1 | TCCGACAAACTTCGCTGCGGGGTCAGGC TTATCCAGAAATCGTGCACAGTTCTGTT GTCCAATCCCTGCCCTTCAGATGTTTTTA AGGTTTGGGGGCCGTAGGTCTTCCTGAG ATAGGAGCCCTGCAGCCTGCCCTGCCAT CCTAGAGGTGGGAGCTGCAGTGCACCTG GCAGCCAGGCCCTGGCCAGTCGAGGGTG GGGCTGTGAGGCAGCAGGGAGACCTTCG TGCTCCCAGTGAGCGGAGCCGACTCCAC TGCTAGCGGACTAGA | 0.046795588 | 0.007478615 | 2.60E-06 |
| 406 | 3676115 | 2 | NME3 | AGATGCGCGTCACAGAGGCTCTCACACT CCAGCCTCCTCCAGGGCCCAGGTGGGCG GGCTTCTGGCCCCACCCCACAGCGCTTG GAGCATCCCTTTGGACGGGCTGCTGAAC ATCCACCTGTCTGGACGTTGCATGGA | 0.000203565 | 0.011839051 | 7.55E-06 |
| 1315 | 3676601 | 4 | CASKIN1 | TGTCAGTGTGTCAGGGCACCTGTGCGGG CACGGACAGGGCTCTGCA | 0.001168298 | 0.007803578 | 3.44E-06 |
| 299 | 3677917 | 2 | ADCY9 | CCGAGGTGCTCTGTTTGTCGAAACACAG TAATATTTGTATTTGGCTGTTGTGCTTTC CAAGCGCCACAGTTGCCCTCCCCGGACG TGGTGTTATGTGGTCATTTCAGCCCTAAC TTCTGTGTGGATCACAGTTATTCAGGGTT CATTTTCATCCATTCTTCCCTTTCGCTCCC TTCCCTGGAAACCCCGCTGCCTCTGGGTC ATCCGTTCAGCACGTGGTGGAGAACAAG TGCCTTCAGGGCTGGCCTCGGCCTCGAG TCTCGGGACAGAGGCCGCCAGTGGAGAT CATGGCTTTGGGTATTATTTGACTTTTAG AACAAAAGCTGTGGTTAAGATCTCATTT TTATTGCTTTTTCCCACGTCCCACGAGAC ACTATTTTCGGTTCTCTGGCTAATACCCT GTTTTTGAGTTTATTTGTTTCTGTCTATG TCACAGTGTTCCTCTACGACCCGACCTCT CTATGTAAGCACA | 4.55E-05 | 0.019273282 | 1.32E-05 |
| 974 | 3680474 | 7 | SNN | ATGTGCACGTGAGAAATGTTCCCTGGGT CCTAAGTGCCTTTAGAGCTGGGTCAGGG | 0.001283816 | 0.008241237 | 7.03E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 2015 | 3680538 | 9 | ZC3H7A | GACTGGAGACCCGCTGAGGAAAGTGAA GTCAGAACCCCATAGGCGGACGGTCATC AGAGA CCAAAGACCGGCGTGCGATGAGAGTGAT GTCTATTGAAC | 6.62E-06 | 0.008429013 | 5.75E-06 |
| 1898 | 3681408 | 4 | PARN | GTGATAAACCCAGGCAACATTCTTTTCA AATGGATAATCAAAAGAGAGAATTGATC AACCAAGATGAAAGTGTCATAAGGAACC AATAAGTGATAATGTTGGAAGTGAAATT CAAATCAAACAAGTAGAATTATAAAGA AGAATTAGCTGACCACGGGAATGTTGAC ACTGCTGCCATTTGAGTTACTGTAAATCT GCAGCCAGAGGAACTTAACGAAGGCAA CTTATCAGCATAAATGAGGAAAGTGGTT GTGACAAAAAGGATGAAGATGTCCCAG AAGAAGTAACGCCAGCACA | 0.000110135 | 0.006617645 | 5.82E-06 |
| 1242 | 3685365 | 1 | | CCAGGCAATCATTCTATTAAGGATGTGC TAGATGACCCACAGACTCAGGCCTGACT CCTCAGGAGCTCACAGTTAGTAGGGGTT CAGACAAGAACACAGGTACATAACTAA AACTCTATTGATAAGGGCGCCTCGGTAA GGTGCTATGGGAAC | 0.030555206 | 0.008234817 | 1.17E-05 |
| 1091 | 3685648 | 9 | ARHGAP17 | AAATCCTATTTACGGGAATTGCCTGAAC CTTTGATGACTTTTAAT | 0.005416181 | 0.009485484 | 9.37E-06 |
| 1253 | 3685774 | 1 | | AGTGAGCTCATCAAAAGCACGGACAGG AA | 0.01415169 | 0.011101576 | 7.70E-06 |
| 1422 | 3685788 | 1 | | GATTCTACCTCTGCTCTTTCCGCAATCCA CCAAGCCCCGTAAACTTGCCAGAAGTTA CATTGTGTCTGCAGTTATAATGTTTAAAA CATGCTCTCACTTGACCCCAGGATTCTCA TTAGCTGGGTTACCC | 0.002080741 | 0.008376621 | 5.65E-06 |
| 331 | 3686345 | 4 | XPO6 | ACAGGACTGAGCTTCTGTGCCTGGACTG AACTAGTAACTTTTACACCCAGGAATTC CAAAGCAGTTTAAAAATACTTTGCTTAG CCCCCAGGCAGAGGCTTAACCTCCAGG | 0.002571681 | 0.009429634 | 1.25E-06 |
| 1324 | 3686981 | 8 | RUNDC2C | TTGTGTGGGCGTTATAGGACAGACCGTG GGGTGGGGCGGGGATGGGGAGGTGG ACAAATGAGGTCTGGATGAGAAGTGTGA CCAGGCGTGTTTGACTCATGC | 0.000751323 | 0.010013645 | 2.70E-06 |
| 1100 | 3687400 | 1 | | GTCAAGAGACACAGTTACCATTCTTGTG CAGGCCTCCAGAAACAACATATGAACAA CTAAGCAAACACGGCTAAGCTCTTTCCC T | 2.99E-05 | 0.009900281 | 3.48E-06 |
| 435 | 3687775 | 5 | ZNF48 | CTGAGTCACAGAGGACGCAAAGGCAGA GAGAGACCGAGGGACAGCGGCTGACCA AAAATAAGGGGAGCCAAAGATTAGCCG CTAGAGACAGAGACGTAGAAACGGATA AGAGATAAAGTCATTGACGCAGAGTCCG AG | 0.009627872 | 0.010281022 | 1.32E-05 |
| 244 | 3687981 | 3 | C16orf93 | ACAGCTGTTGAGTGAAGTGAATGAATGG ATACCAGAGAGGGCCTCACTGC | 3.74E-05 | 0.012026254 | 7.79E-06 |
| 207 | 3688068 | 3 | CTF2P | TGAGCCCATCAGTCAAGCCTATAGCCTG GCCCTCTACATGCAGAAGAACACCTCAG CGCTGCT | 3.07E-06 | 0.018860953 | 1.72E-05 |
| 2044 | 3689930 | 2 | VPS35 | CGCTAGGTTTCCCTTCCATAGATTGTGCC TTTCAGAAATGCTGAGGTAGGTTTCCCA TTTCTTACCTGTGATGTGTTTTACCCAGC ACCTCCGGACA | 0.000319739 | 0.007906231 | 5.17E-06 |
| 1660 | 3689951 | 9 | VPS35 | TCAGTTGGAAGGTGTAAATGTGGAACGT TACAAACA | 6.38E-06 | 0.00913068 | 8.04E-06 |
| 1364 | 3690072 | 5 | GPT2 | TGGCTCCCTGTTGTTCTTAGCACAATGAC CCAAATCCTCAGCATGGCCTCTAAGGCC CTGTACTGGTGCCAGCTGCCTTGCCAGC CCACGCCTGGTAACTCCGACCCTTGCTGT GCACTCATCCCCCAGCATCTCCAGTTCCC AGCACTCAGACTCCTGCCAGCTCTAGGC CTCTGCACACAGTGACCTTCAGCTCAGA GCACACCCCTCTCCCAGTTCACTCCTGT GTGTCCCTCAGGTCGGTGTCTACT | 0.001561876 | 0.010540522 | 6.53E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1989 | 3694664 | 2 | CDH11 | TCTAACGCTGAACTGACAATGAAGGGAAATTGTTTATGTGTTATGAACATCCAAGTCTTTCTTCTTTTTTAAGTTGTCAAAGAAGCTTCCACAAAATTAGAAAGGACAACAGTTCTGAGCTGTAATTTCGCCTTAAACTCTGGACACTCTATATGTAGTGCATTTTTAAACTTGAAATATAATATTCAGCCAGCTTAAACCCATACAATGTATGTACAATACAATGTACAATTATGTCTCTTGAGCATCAATCTTGTTACTGCTGATTCTTGTAAATCTTTTGCTTCTACTTTCATCTTAAACTAATACGTGCCAGATATAACTGTCTTGTTTCAGTGAGAGACGCCCTATTTCTATGTC | 0.00207602 | 0.008120261 | 7.70E-06 |
| 1250 | 3694693 | 9 | CDH11 | CCCTACCCAACATGGACAGGGAGGCCAAGGAGGAGTACCACGTGGTGATCCAGGCCAAGGACATGGGTGGACATATGGGCGGACTCTCAGGGACAACCAAAGTGACGATCACACTGACCGATGTC | 4.31E-05 | 0.008270469 | 7.34E-06 |
| 928 | 3695096 | 9 | AC132186.2 | GGGACCTCACCACACCCATACACGGGACCCAATGATGGCTCTTGTGGACTATCACGATGGCGTCATCGCCAGCACG | 0.008619147 | 0.011094646 | 1.11E-05 |
| 1423 | 3695391 | 7 | CES4A | CCCTGTGTATAGACTTTGGAGTGGCCCTGGGGGAGATAAGTGTGGGTGGGAGAGAAGATCCCAAACTACCAAAAGTTTGCTCCATGTCACAACCTGCCCTAGGCCTCCAGGCCAATGTGAACAGACAGGCACAAGGTTGAGCAGGATGGATGGTAAATGCCAAGCTGGGTGCAGTGATGACAGGGGCAGTGGCAGTCTGGGTCGACCTCCCATAAGAAGGAGTCACAAGGAGACATTGAAGGGTGGGAGGATTTGAAGAAGGGAAAAAAAGAGGTTGTCCTGAGGCTGGAGAGCTGAGCACAGTGTGGTGTTGACAGGGCCTGGCCTAACTGGATGTCAACAGTGAAGTAGAGGGGCATCATGGGATGTCAGGCTGGAAAGGGCAGTGCAGGTCCCACACAACAGGCA | 0.0038061 | 0.006571526 | 5.20E-06 |
| 586 | 3696274 | 1 | | GCCTCCCGCAAATGGCTGGCCAATAGGGACTCGCCGCCATATAC | 0.001689593 | 0.009564298 | 6.29E-06 |
| 1247 | 3699295 | 5 | ZNRF1 | CCTGGGGCTTTCCAGAGTCCGGCTGTGAGCGCCCAGCTTGCTGCTGGCGTGGCGCTGGGGAAGCGGGGCTATGTGGGGAG | 0.000873066 | 0.008486615 | 4.04E-06 |
| 1690 | 3699734 | 9 | ADAT1 | GTGGGGATGCCTCCATCATTCCGATGCTTGAGTTTGAAGATCAGCCTTGCTGT | 0.000712087 | 0.006749163 | 2.51E-06 |
| 685 | 3699913 | 1 | | GCCTGTCCATTTTTAAGCCTCCAGGAAACCCAGGCTGCAGCTTCCAACTATGCCACAGAGCAGAGTTTTTCCTGTGCCAAGAGGGCTCTGATGAGAAGACCTGGTTGCTCCCTTCTGGAGAAACAGAGGATTGCCTGTCAACAGATGGGCTACAATTGCTTCTCTTTGGAGAACCAAGAGACTCCCAGTCAACAGGTGGGCTCCATGTGCTCTTCTCTGGAGAAACAAGGGATTTCCCAGTCAACAGGTGGGTTCCCAGTGCTCCTATCTGGTCGCAGGTACTG | 1.41E-06 | 0.013152305 | 1.07E-05 |
| 295 | 3703547 | 1 | | TCCTGGAAATGCCATTGCCCCCCTGGGGCCTGACCCTCGCTGGCAATCCTCCACTTCCC | 0.000221959 | 0.015552834 | 1.72E-05 |
| 1715 | 3704487 | 4 | FAM38A | CTGAGGCGGTCCCACACTTTGGAAAAAATAGTGTGGGTTCCTCCCTGGTCCTCCCTTGCCCTACTGGGCTCAGTTTCGCAGGGGCGGGGGCCGGCCTCTGCCCTGGTCTGGGGGAGGGGACACCCCGGAGGCTGTGGCCTGGTGTCAGGGCGGGGCAGGGGTCCCAGTCCTGGCATCTGTGTTCCCTGCTTGCCGGGCAGTGGTGCCCCTTTCGCAAGCACACCCGGGTGGCTTGGTGCTGCACGGCCTGGCACCCCTACCCTTCCCGACCCTGGCCTAGCCGGGACCCAGGGTCCGCGCCCTCCGCCCGGGGGCTCCCACGTGTGATTGATCTGGGAAGCAGTCGGATGGAATTAACCCA | 0.022526284 | 0.006567648 | 3.55E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | CGGACAAGTGGGACGGTTTGCATTTGGGA | | | |
| | | | | GTCCGCCATGGACACGGCAGGTGGGGCC | | | |
| | | | | TTTTGATTGTAAAAGCCCTTTCGGAGCCC | | | |
| | | | | TTGCCTCGCTCCAGGTGGGAGCTCGCCC | | | |
| | | | | AGCGCTAGCTTTGGGGATCTAGAGCCGC | | | |
| | | | | CTGCCTGAGGCTCCCAGACAGACTGCGT | | | |
| | | | | TTTGATCGGTCGCACAGAAAGGTGGTGA | | | |
| | | | | AACTTGGGGAAGATTTTCTAGACAGGAA | | | |
| | | | | TCAATGAAAACCATTGAGGCTGGAGAGG | | | |
| | | | | AGAGGTTTTGAGCAACTCTCTTCAGTGC | | | |
| | | | | GGTCAGCCCTGTGTGGACTGGGCAGCCT | | | |
| | | | | GGGACCTGCTCCCAGTGCAGGGTCAGAT | | | |
| | | | | GGGCCGTAAACAGGGCCCGGCTGTGTTC | | | |
| | | | | CTTCCTGTGCCTTGAAAACAAGCAGGAC | | | |
| | | | | AGCCTGGCACAGAGGCAGAGTCTAGAGC | | | |
| | | | | TGACAGGCCTTAGAGAGGGAAACAGGA | | | |
| | | | | AAGCTTCTGAAACGTCCCGTTCACACTG | | | |
| | | | | ATCGTTCCATTTCCTCTTGTGTCTGAGTG | | | |
| | | | | GGAGCGGGTGTCCTCCCTGCAGGGAATG | | | |
| | | | | CCCCCCCTCTCAGATGGCAGCTGCTCCTT | | | |
| | | | | GGGCAGAGTTGGCAATGTTTTTCTTTAA | | | |
| | | | | ATGACCAGATGGTAAATATTTTCATGTC | | | |
| | | | | ACAAAATCTTCTTCTTCTGGTATTTTTCC | | | |
| | | | | AGCCATTAAATGTAAAAGCCCTCCTGAG | | | |
| | | | | TTCATGGGCTGTACCTAAACAGGTGTTG | | | |
| | | | | AGCCCGATTCTGTGGCACATGTGGTTTG | | | |
| | | | | CTGCCCCTGGGCATTGGTCAGGGGGCC | | | |
| | | | | TGGGTTCTGCCTTCTCGATTGCTATCCGC | | | |
| | | | | GTGGGGATCTGGGGAGGGATCACTGT | | | |
| | | | | TCTTCTTGCTTTTGGCCTCCTTGGGGAGG | | | |
| | | | | ATGGGGAGGTAGCCCAGGGGTGCTCACC | | | |
| | | | | CAGGCCCCGTGTCAGTCTTCTATGAAAC | | | |
| | | | | TTTTAAAGAATAGTGATGACTGACTGTC | | | |
| | | | | TGTCTGTATGGTACTTTCCTTAAACCTAA | | | |
| | | | | AACTGGTCCCAAATAAAGTCTCTTAATTT | | | |
| | | | | GAAAGATGCTGAAGCCCGGGCCATACCC | | | |
| | | | | CACACTGATTCTGTGTCTGGGGATGGGG | | | |
| | | | | CGTGGGGCCTGGGCCTCACTCAGTGTTTT | | | |
| | | | | CTCTCAGTCACCTGGGGGAGATGGAAGT | | | |
| | | | | GGAGCCGGCCAAGAACCCTGCCTGCCTG | | | |
| | | | | CCTGCTGGCCGGGACTCCTGAGTCAGGC | | | |
| | | | | TCTCTGGCCCTGGGGTGTGGGCAGCTCC | | | |
| | | | | AGATGGACCCGCGATGTGCAGGTTCAGC | | | |
| | | | | TGGCCTGGCCGGAGGTGGGACACTGGCT | | | |
| | | | | TTGCTGTCTTTGGAGTGCCCCCTCCCTCT | | | |
| | | | | CTGGCGAGCTTTGGCTGGAAGCAGTTCT | | | |
| | | | | ACCGTGTTTTGGAAATGAATGAGGCCTT | | | |
| | | | | CAGAAGGCATTAGTCAGTGTGTGCCTGC | | | |
| | | | | GCTGGCTCAGACAGTGCCTGGTGAGGGT | | | |
| | | | | TTGAGTCATCCTGGGGTGCCCCTGGCCC | | | |
| | | | | CCACGCCCTCCCTCTCCAGTGCAGGATC | | | |
| | | | | ATTACCCAAAAATCTGGCAGGGAGCTGC | | | |
| | | | | CCCACCCACAGGGAGCAGGGGCCTCCTT | | | |
| | | | | CAGCAGTCTCACCTAATGTTGCTGGAGC | | | |
| | | | | CTTGGGGATCAGGGCCCATCTCTTCTA | | | |
| | | | | GAGAGATGTCAGGGCAGGGCTGGGCGC | | | |
| | | | | GATGGCTCACACCTGTAATCCCAGAGCT | | | |
| | | | | TCGGGAGGCCAAGGTGGGAGGATTCTT | | | |
| | | | | GAGCGTAGCCATTCGAGAGCAGC | | | |
| 640 | 3704496 | 1 | | GGATCCCAGGGAAATATCAGCCTTGGGC | 0.012720391 | 0.009555613 | 5.12E-06 |
| | | | | AACTGCAGTGACCAGGGGCACCGGCTGC | | | |
| | | | | CCACAGGGAACACATTCCTTTGCTGGGG | | | |
| | | | | TTCAGCGCCTCTCCTGGGGCTGGAAGTG | | | |
| | | | | CCAAAGCCTGGGGCAAAGCTGTGTTTCA | | | |
| | | | | GCCACACTGAACCCAATTACACACAGCG | | | |
| | | | | GGAGAACGCAGTAAACAGCTTTCCCACA | | | |
| | | | | AGAGCCGTCTCCTGTCCTCCTGTTCCCCA | | | |
| | | | | GGGCAGGGAGCCCCAGGACAACACCAG | | | |
| | | | | ACTTCAGCTGTACTGTGGG | | | |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1995 | 3707126 | 2 | ARRB2 | CCCACTGTCAATGGGGGATTGTCCCAGC CCCTCTTCCCTTCCCCTCACCTGGAAGCT TCTTCAACCAATCCCTTCACACTCTCTCC CCCATCCCCCAAGATACACACTGGACC CTCTCTTGCTGAATGTGGGCATTAATTTT TTGACTGCAGCTCTGCTTCTCCAGCCCCG CCGTGGGTGGCAAGCTGTGTTCATACCT AAATTTTCTGGAAGGGGACAGTGAAAAG AGGAGTGACAGGAGGGAAAGGGGGAGA CAAAACTCCTACTCTCAACCTCACACCA ACACCTCCCATTATCACTCTCTCTGCCCC CATTCCTTCAAGAGGAGACCCTTT | 0.001628328 | 0.006507684 | 4.21E-06 |
| 1610 | 3708862 | 9 | CD68 | TACCAAGAGCCACAAAACCACCACTCAC AGGACAACCACCACAGGCACCACCAGCC ACGGACCCACGACTGCCACTCACAA | 0.00071035 | 0.010528404 | 1.33E-05 |
| 541 | 3711048 | 6 | | CCACGTGTTTGGTGTTGGTTATACATTAA GATGGGGCGGGAGTGAGAACAATCTCTT AACATTCATTGAAAAAAATACTGAAACA TATTTTCAGCACAAATATTAAACTGTCTC TTCTCTACCGATTGGTAAAAAAATATATT ATATTTTGATTTTTTTTTCTTTTTAAATT ATATGGTTATCCATCCCAGCCAAAGTCG TGCCCGGTCATCTGGTAGAACT | 0.000996275 | 0.008838354 | 6.05E-06 |
| 1493 | 3711987 | 9 | PIGL | CTCTGGGTTTGGGACTCCTCAGAACGAA TGAAGAGTCGGGAGCAGGGAGGACGGC TGGGAGCCGAAAGCCGGACCCTGCTGGT CATAGCGCACCCTGACGATGAAGCCATG TTTTTTGCTCCCACAGTGCTAGGCTTGGC CCGCCTAAGGCACTGGGTGTACCTG | 0.013379902 | 0.008147589 | 7.37E-06 |
| 1454 | 3717119 | 9 | NF1 | TGCTTAAAAGGACCTGACACTTACAACA GTCAAGTTCTGATAGAAGCTACAGTAAT AGCACTAACCAAATTACAGCCACTTCTT AATAAG | 2.26E-05 | 0.009405833 | 4.88E-06 |
| 561 | 3718005 | 5 | ACCN1 | TGGCTGATAAATCTGTGGACATGTGAAA ATGAAGTGCAGCTTGCTATATTATAGCA TCCAAACTGCAGGGGAGCCAACAAACAT CTAACTCTGCCCACTCATTTTACCACTGG GGCGAACGAGGTTCAGGGAGGAGCAGG GACTCACCTGAGCCCAGGAATAGGGAGG CTCAACGGAAACTCAGGCCATTG | 0.033664154 | 0.007046032 | 5.45E-06 |
| 1112 | 3718104 | 5 | ACCN1 | CCCGGTGAAGTACGCATGTGAGCTCATC CAATCTGCAGCCACTCCAGGAGGAGGGC ATCATTATCCTCAATAAACAGATGAGCA AACAGAGGCTCATGGAGGGTCAGCGAC GTGTCCAAGGTCACTGACTCATCAGAAG GCTACTTTGTTCTCACTCCATCAGGTGGC CCAAGG | 9.72E-05 | 0.009822418 | 5.26E-06 |
| 665 | 3718684 | 4 | AP2B1 | ACGGAGAGAAGGGTAACACCAGGCTGG GTCGGAGACCGGCGGAGGCGAGGAAAT CCTAAGAGCGTGACCGTTGATGATGCAG GGAACCGTC | 0.000742232 | 0.008729072 | 4.07E-06 |
| 1314 | 3719372 | 9 | AATF | AAACTACAAAAAGCTCTGTTGACCACCA | 0.000461778 | 0.007820628 | 6.09E-06 |
| 847 | 3719860 | 1 | | TGCGTGCCTAGAGGTCAAGTGTAACTGG TGTTCGTGAGCACCTCGTGGTTGCGGGT CTCTAACTCTCGTGGGTCTCTAAGCGCAC CCGCGGGGCTGGAGCGGAGGTTCGTGTC TCTGGGAGGGTCAGTGGTGTGACTGAAG CTGGGAGTTAGCTCGTGTCTGTGGGTGC CTCGGTGTGTGTCTCTGGGGCTCTGAGTC CCTGTGCGTGCGTGTGTGTCTGTGAACCC GACAGGAAGCTCCCCGAGGGCAGGAAT ATGTTTTGCTCTCTACTCGATCCCAGCGA CTGGCAACGAGCGTTTAATA | 0.019317948 | 0.007902788 | 4.29E-06 |
| 1387 | 3719966 | 4 | PSMB3 | CTTTTGACAATGAGAGTAACCCAGCCAC TGAGTATCCCTCTTTGCCTTGCTGCTAG GGGGCTCAAAACAAACTTTGTGTTCAG TCTGAGTTATCTTGTATTATGTTTTAATG GTTTAGTTTTATTTTTCAGTGTTTTTCATA TAAACTGCCTCCAATCTTTTCTCTAAAGG AGTAGAGGTATAAACATACACATAGAGG | 0.000155402 | 0.008781182 | 3.21E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 762 | 3720001 | 2 | LASP1 | ACTGAGTGATGGTAGGACCTTGGGTGAG GAGAGGGAGGATTAGAAGAAAACAATT CTGAAAGAAAGAAGGAGCACAAGAGGG TCAGAGGTGAGAAGGATAGAAAGGTAA GTGTTGAAGAAAAGAAAGTGGAAAAGT CTTAGAATATTTCTAGCTGGCAGGAGAA GGGAGAGGGAGCTGGCCTCAGGGAAAG GTGATCTTCCTAAACAGGTCCTCCATTTC CCTTTGGGTCTGGGTCTAGGCCGGGGCC TTGTCTGAATAGGCTTAAACATGAAAGC GAGCGTTCTTGAGTTCTGGTTTC GCTGGGCGTCTGTTCTTTACCAAAACCAT CCATCCCTAGAAGAGCACAGAGCCCTGA GGGGCTGGGCTGGGCTGGGCTGAGCCCC TGGTCTTCTCTACAGTTCACAGAGGTCTT TCAGCTCATTTAATCCCAGGAAAGAGGC ATCAAAGCTAGAATGTGAATATAACTTT TGTGGACCAATACTAAGAATAACAAGAA GCCCAGTGGTGAGGAAAGTGCGTTCTCC CAGCACTGCCTCCTGTTTTCTCCCTCTCA TGTCCCTCCAGGGAAATGACTTTATTG CTTAATTTCTGCCTTTCCCCCCTCACACA TGCACTTTTGGGCCTTTTTTTATAGCTGG AAAAAACAAAATACCACCCTACAAACCT GTATTTAAAAAGAAACAGAAATGACCAC GTGAAATTTGCCTCTGTCCAAACATTTCA TCCGTGTGTATGTGTATGTGTGTGAGTGT GTGAAGCCGCCAGTTCATCTTTTTATATG GGGTTGTTGTCTCATTTTGGTCTGTTTTG GTCCCCTCCCTCGTGGGCTTGTGCTCGGG ATCAAACCTTTCTGG | 0.000136311 | 0.015837481 | 1.21E-05 |
| 59 | 3720978 | 5 | TOP2A | GATCATCTTCATCTGACTCTTCCAGGTAC TTTATAGGTTTCTTTGCCCGTACAGATTT TGCCCGAGGAGCCACAGCTGAGTCAAAG TCCATATGGAAGTCATCACTCTCC | 1.72E-06 | 0.047128916 | 4.13E-05 |
| 44 | 3720986 | 5 | TOP2A | TTTTGGTCTTAGGTGGACTAGCATCTGAT GGGACAAAATCTTCATCATCAGTTTTTC ATCAAAATCTGAGAAATCTTCATCTGAA TCCAAATCCATTGTGAATTTTG | 6.24E-07 | 0.096289981 | 0.000148557 |
| 1557 | 3720988 | 5 | TOP2A | CGTGGAGGGACATCAAAATTACTTTCGT CACTGCTCCTATCTGATTCTGAATCAGAC CAGGGATTTCTCTTCTTTCCTTTTTTGATT GGCTTAAATGCCAATGTAGTTTGTT | 0.000229029 | 0.01011419 | 8.45E-06 |
| 51 | 3720992 | 5 | TOP2A | CATTTCTATGGTTATTCGTGGAATGACTC TTTGACCACGCGGAGAAGGCAAAACTTC AGCCATTTGTGTTTTTTCCCCTTGGCCT TCCCCCCTTTCCCAGGAAGTCCGACTTGT TCA | 2.14E-08 | 0.063588907 | 7.19E-05 |
| 877 | 3721456 | 9 | FKBP10 | TGGGGGATTTTGTGCGCTACCACTACAA CGGCACTTTTGAAGATGGC | 7.36E-05 | 0.009162263 | 6.97E-06 |
| 1512 | 3726146 | 1 | | GGCCCCGTGCCTTCTGACTCACAGCAGC TCAACAGGAAAGCATCTGATCATGCCCA CAGCCCTGGCATCTGGCCCACAGGAGTG GCACCCCTCCCCAAGACCTTCCACACAG TTTCTATATTA | 2.49E-05 | 0.007143351 | 5.19E-06 |
| 1941 | 3726285 | 7 | COL1A1 | AATAGGTACAGAGTCTTTTGCTTCCTCCC ACCCCTAGGGGGAAAAACTGCTTTGGGG TTTGGGAAGTTGTCTCTGAAACCCGGGG ACAGAGGACGCAGGACAGACTAGGAGG GAGCCGGGAGGATGGGCTGCAGCTGTGG AGGAGGGTTTCAGAGGAGAGAGGTCGG AGAGCAGAGGCCTGAGAAGCCAGAGGC AGGTGGAGAGAGGGTGGAAAGTGAGCA GCGGGCTGGGCTGGAGCCGCACACGCTC TCCTCCCATGTTAAATAGCACCTT | 2.08E-05 | 0.010400379 | 8.52E-06 |
| 397 | 3726287 | 5 | COL1A1 | CGGCACAAGGGATTGACACGCGTTCCCC AAATCCGATGTTTCTGCTTTGTCGTGGCC CTTCCTGACTCTCCTCCGAACCCAGTGAG GGGCTGGTGGCTCCCCGGCATGACCCC CTCAAAAACGAAGGGGAGATGTTGCAA | 5.98E-06 | 0.021237214 | 1.83E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | GAGCCATGGGAGCGCCAGATGGCAAGG CTTCTTTGGCAGTCTGAGAACCCCAGGT CCCCCAGGGCCTGGGGGTGCTGGGCGGG CAGGAGCGGGCTGAGGGTGGGGGCCAC TTGGGTGTTTGAGCATTGCCTTTGATTGC TGGGCAGACAATACATTGTTTCCTGTGTC TTCTGGGGAGACAGATTTGGGAAGGAGT GGAGGGGAGGCCCCAAGGGGGGTGTGG AGAAAGGAGCAGAAAGGGCAGCATTGG GGTTTCATAAGCCCAACGGGCAGAAAGG GACTTACCCCCGCATGGGTCTTCAAGCA AGTGGACCAAGCTTCCTTTTTTAAAAAG TTATTTATTTATTCTTTTTTTTTTTTTTT TTGGTAAGGTTGAATGCACTTTTGGTTTT TGGTCATGTTCGGTTGGTCAAAGATAAA AACTAAGTTTGAGAGATGAATGCAAAGG AAAAAAATATTTTCCAAAGTCCATGTGA AATTGTCTCCATTTTTTGGCTTTTGAGG GGGTTCAGTTTGGGTTGCTTGTCTGTTTC CGGGTTGGGGGGAAAGTTGGTTGGGTGG GAGGGGAGCCAGGTTGGGATGGAGGGAG TTTACAGGAAGCAGACAGGGCCAACGTC GAAGCCGAATTC | | | |
| 833 | 3726289 | 5 | COL1A1 | CGTGCAGCCATCGACAGTGACGCTGTAG GTGAAGCGGCTGTTGCCCTCGGCGCG | 2.23E-05 | 0.016265471 | 1.43E-05 |
| 688 | 3726379 | 9 | EME1 | AGAAACCAAGCCGAGTCAGAAGGTCC AGGGAAGAGGCTCACACGGATGCCGGC AGCAGAGACAAGCAAGGCAGAAGGAAA GCACCCTGAGAAGACAGGAAAGAAAGA ATGCAGCACTGGTTACCAGGATGAAAGC CCAGAGGCCAGAGGAATGCTTAAAACAC ATCATTGTAGTGCTGGATCCA | 0.000474683 | 0.00860949 | 8.22E-06 |
| 1144 | 3728550 | 1 | | TGGGGCCATGTCTGATGAAAGCTTGGTG ATCCCTTTTGGGTCAAAAACAAGCTCTG ACTGAAGAGATGCAAGATTTTCTCAGAT GATTTGTGTGTCAGTCAGAGTTCCGCCA GAGAAACACAACCAGTAGGATATATTCT ATCTTGTCTGTCTTCATATCCATGTATCT GTCATCTACCTAGATTTAATGCAAGGAA TTGGTTTATGCAGTTGTAGGGGCTGGCT AGGCAAATCCAAAATCCACAGGGCAGG CCGTGTGGAAGGGAGGTCTGGAAACTCT CAGACAAGACCTGACATTGCAGTCCACT GGTGGAATTTCTCCTTCTTCAGGGAAAC CTCAGCTTTCAACGGAGTGGATCAGACC CAACCATATTATCCAGGATAATCTCCTTT ACATAAAGTTAACTGATTGTAGATGTAA ATTACATTTACAAGATACCTTCATAGCA ACACCTAGGTCAGTTTTTGAATAACTGG GTATTATAGCATAGCCAGGTCAACACGT AAAATTGATCACCACAGTCCATGTCTTG TTAACTTGGCACCTGTA | 0.000862602 | 0.011254423 | 5.64E-06 |
| 615 | 3728572 | 1 | | ATGAAGGAAACCACCCTAGACCTAGAAC ACGGCCAAGACACTGTAAAGCTGAAGA ATAGGGAGAAATTTCTGCATGAGGCTAA GCAAAG | 0.00028925 | 0.009148564 | 6.03E-06 |
| 1305 | 3728970 | 9 | PRR11 | TGCCCAAGTTCAAACAACGAAGACGAAA GCTAAAAGCCAAAGCCGAAAGATTATTC AAAAAAAAGAAGCCTCTCACTTTTCAGT CCAAGCTAATTACACCTC | 2.42E-05 | 0.013089929 | 7.09E-06 |
| 99 | 3729181 | 9 | CLTC | AAAATCGTGTGGTGGGAGCTATGCAGCT ATATTCTGTAGATAGGAAAGTGTCTCAG CCCATTGAAGGACATGCAGCTAGCTTTG CACAGTTTAAGATGGAAGGAAATGCAGA AGAATCAACGTTATTTTGTTTTGCAGTTC GGGGCCAAGCT | 6.11E-08 | 0.03000392 | 3.82E-05 |
| 1068 | 3730880 | 5 | STRADA | GGACCCAGGCCCAAACCAGTGAGATTAA TCTACCACCCTGTTGGCTGACGTTTCACG TGTATCTGGTTTGTTTGTTGTTTGTTGCT | 3.45E-05 | 0.008004559 | 4.75E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GTTGTTTTTAAGATATGGGTTATCTCTTT GTCGCTCAGGC | | | |
| 1655 | 3731133 | 1 | | ATACAACATCCACGAGGGTCCCTGCAGC TGTGTCACTGAGGCAAACAGGAAAAGTG ATTTTGGCTAGGCGTGGTTCTCATCTGTG AAATTCCACAGCGCAATGACAGCAGCCT CTCTCCCACCCACTCAAGACACTGTCAG GAATGTCTTAAGACCTCAGGAGACCACT TCTTTAGCAAGCAATTTTGTTTTTTGTTTT TTTTGAGATGGATTCTCACTCTGTCACTC AGGCTGGAGTGCAGTGGCGCGATCTCCG CTCACTACAACCTCCGTTTCCTGGGTTCA AGCGATAATCTCACCTCAGCCTCTTGAG TAGCTGATACTACAGGCATGCGCCACCA CGCCCGGCTAATTCTTGTATTTTTAGTAG AGACAGGGTTTCATCAGGCTGGTCTCAA ACTCCTGACCTCAGGTGATCCGCCCACC TCAGCCTCCTGAAGTGCTGGGATTACAG GCGTGAGCCACCTTGCCTGCCCTGGCAA GGAATACATTTTTAAAAATTAGTAAGAA ACATACACATTTCAAGTTTTCAATTAAG AATAATATTTGCTGATGGCACCATCTTCC TGTCTTTCAGCCITCAGCATGGTAGAGG AAAAGAGAAAGAGTGTAGACAAAAACA GTTGAAGAACATCTGTGCTTGTTCCACCT TCATTTTCTGTTTTGTGCGTTGCCTGAAT GAACGGTGTCTTCAGGTTGGTATTTCAC AGGCGGTGCTCCCAAGTAGTCTGGTTTT CCCATTTGTGGAGGGCGAGGTCATAGAG GGGACAGGGGAGGCTGTCTGGTCAGCA CTGTGTATTTCCAAAGAACAAGGACTAG CCAAAACTACAAGCCTTTGAAGGACCAA AGGAAAAGAGAAAAAACCAGCCTCTAA CCAGGCCATGCGCTAGAAATGATTG | 0.001204733 | 0.00994669 | 1.39E-05 |
| 1674 | 3731143 | 6 | | AGTTAGTTCTGCCTTCGGGCCATGACTCG CTCAGCAGAAGGCACTGCCCACAAGTCA CCGTTGAGAAACCCGCCCTGTG | 8.09E-05 | 0.006870019 | 2.73E-06 |
| 1254 | 3732739 | 6 | | GGACGAGGCTGATTCCGATTATCTGGAG GAGCTGGAAGACGACGACGACGCCAGTT ACTGCACAGAAAGCAGCTTCAGGAGCCA TAGTACCTACAGCAGCACTCCAGGTACC CACCCAGCCCAGTTGCTGCAGACTCCTT CCCCACCTCCTCTGCCCTCCCCCCTTGCT CACTCGTGTGCTGTGCATCCTGCTCCGAT CTCCCCCCAACCCCGCCTCCCCCCCAAA CAGAGGGGAAATGCGAGGGCACATCAA GTGGCAAAAAACTAGATTTACAAGAGGA AAGAGGCGCATTGTTAAAAATGGAGATT GCATTGTTGCAGTTTGCAGGCTACACTC GCTCGCTCTCTCTCTCCCCCCCAACCTCC TCTTTTTCCTCTTCAAAATTTGTGCCAGT GCAGTGTCTCCACCGGGCAGGATTGAAA CTTTGGCAAACACGTATCCATTGCATTCA TTTCTTTCCCCTTGTTTTGGTCTGGTTTTC TGGAATGAAAGAAGCCTCTTGTTTTACA AACCTCTTTGCATTTCTAATGTGGTTTCT TTCAGATTTTTATTAGATATGTTACTTAA AAGGGAATTAAGGGTTTGGACAGATTGT GGCACACAAACACACACAAAAACATGTC TGTTTTCACATCCCTAGCTGTGGTTTTAA AATTGTGTTAAGGAAATGGATCATTTGG GTTAGTAGGGGAATTTTATCTGGTCCTGT ATGTTTGCTTTTATTCTTCGAGTGCTAAT GGGCCTGTGCAACAGTTGCTGGTAAATG GCTGATTAAAAAGCAAAGCAGAAAGCC AAACAAGACCCACCCAACTTTGGTTATT CATTCGATTCAAAATTGTTTTTGGTTAAA TCAAAAATGAAAGTACAAAACCGCAGG AACGCGCATCTTAGCTCATTTGATCGCTT TGCCTTGCTTGGGAAATGCAGTTTCGTGT | 6.32E-05 | 0.009173345 | 7.10E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CACCTGTTGCAGAAGATATGTAGTTGAT CATCTAGACATAATTGCTGAAGATAAAC TTTTGGACCAACTTCTAAGTCACACAGC ATCATTATCAGATTTATTACACAACGACT TTTTTGTTTTCACTCTATTTCTGAGGAAA AAGCCTTCCCGAAATCCGTAATGAATTT CTCCATGGTAACCCCTCTTCTGTTTTCAC ACAGAAAAGTTTCTCTAGACTGTTGCTA AGATGCATTTTGTTAAATACCCCCCCCCC ACAAAGGCTGCTTTGTATTAAATACGTA GTTGGAATTTACTAAATTGTGAAATTAA CGTAACCGAAGCAACAACCGGCAAGACT TT | | | |
| 569 | 3734860 | 9 | KIAA0195 | GGTCCGAGTCCGCTACCAGAAGCGACAG AAGCTGCAGTTTGAAACTAAGCTGGGCA TGAACTCTCCCTTC | 0.000712087 | 0.010991321 | 6.89E-06 |
| 1110 | 3735014 | 2 | MYO15B | CCTCTTTGACGTGGGACATGTGACAGAG CAACTGCACCAGGCAGCCATACTGGAGG CCGT | 0.000203031 | 0.0074482 | 3.26E-06 |
| 773 | 3735349 | 9 | C17orf106 | GCTGCCCAAACCTGGGACCTATTACCTC CCCTGGGAGGTTAGTGCAGGCCAAGTTC CTGATGGGAGCACGCTGAGAACATTTGG CAG | 0.012043037 | 0.009510322 | 6.39E-06 |
| 844 | 3735745 | 1 | | AGCTGTGGCCGGAAGGAAAGCTTCAGTG ATTCCCGAAGCAAAGCAGACAGTCGAGT TCGGAGT | 0.004194748 | 0.007501714 | 3.37E-06 |
| 938 | 3737994 | 4 | RP13-766D20.2 | CAGAGCTGAGGCTTAACCCAGGGCCTGC GCCCTCCACGGCCTGCACTGCCCCACCT CCAGCTCCTTGCCCTGTTCCTCCCTCTGC ACCGGATCAGCCCCCGGACTCTGGGTCA CCTCCACACCAGTTGACAGGGCCCCCCA GTCCCCACCGCCAACCACCTGGCCGGCT ACTTGTCAGACA | 6.62E-06 | 0.009372956 | 8.59E-06 |
| 940 | 3740825 | 3 | MIR132 | TCCAGGGCAACCGTGGCTTTCGATTGTT ACTGTGGGAACTGGAG | 0.006674036 | 0.007581392 | 2.03E-06 |
| 225 | 3742407 | 4 | PFN1 | GTCCGGGGCACTGCTCCGGTTTGGACCC TGA | 0.000909538 | 0.012421274 | 8.61E-06 |
| 223 | 3743231 | 1 | | CTCTTGCAAAAGAGGCTCCACATTTTCC AGGCTTTGATGAGAACTTCGACATAAAC GTCAAACACAGTTCCTGCATCCGAACCG ATTCTGAGGCCTTGTA | 4.19E-05 | 0.015381152 | 5.64E-06 |
| 599 | 3743292 | 3 | MIR497HG | CCAGGAGATCCACAGGTCCGGCATGAAC AGTGAGAGGTCAGAGGTGGAAGGCTCA GCAGGAGAGGAGAGGAGGATCAGCAGA GGTCATGAGAAGGCCAGAATCCAGGGTC AGGCTGTCTGGAACAGGAAGTAAAATGG GCCGAGATGGAGCGAGCCCCAGTGTGC TTCCAAGGCCACTCCCACCTCCCTGAAA CACCCTGCTACGTACTGATCGCAATGCCCT GCGCTGTGTATGAGAGC | 0.001098492 | 0.009759828 | 2.84E-06 |
| 1788 | 3745080 | 1 | | TGAGTGACACCGTGGGATTGCAGAACCA CACGCTAACCATGAAGAATT | 0.000126422 | 0.008893994 | 4.71E-06 |
| 870 | 3748225 | 9 | FLII | GAGTGGGCCCAAGGACCCTATGGCTCGC AAGATGCGACTGCGGAGGCGCAAGGATT CAGCCCAGGATGACCAGGCCAAGCAGGT GCTGAAGGGCATGTCAGATGTTGC | 0.025777155 | 0.009133044 | 8.23E-06 |
| 608 | 3748820 | 7 | RNF112 | CCAGAGGCATTGATGCGAACCAGCAGCA GCGGCTCCGCCCTCACAGGACACGTCTC CTGGGCCAGGAGAAGAGAGGGGCCCCT GAGCATCCAGGACCAGCTCCTGACCCTG GAATGTGTTCAGCCTGGAGCTCTGTGTC CTGATGTTCTAGAATAGGGCCAAAGCCA CCCCCTCCTCTTGGGTCTGACTGATTAGG | 0.001543869 | 0.008899881 | 2.96E-06 |
| 344 | 3749011 | 2 | ULK2 | AGCTTTTCCATTTGGTGCTCCAATGTCTC CTGCTGGACCCATCTGCCTAGTGGAAGG CAGCAAAATTTCAAGAAACAGGTGAGGT TGAGCAGCTTGGTGCAACCCCATGGGGC CTGGAGTTGGAGCTCAACAGCAATGGAT TTCAGAGACCACCCTGAAACTCCCAGTA AAAAGACTTGGGAGACATGTTAATA | 1.52E-05 | 0.014790792 | 6.57E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1388 | 3749061 | 9 | ULK2 | AAAACTGATTGGGAGGTAGCTATTAAAAGTA | 0.000310049 | 0.006756375 | 6.24E-06 |
| 1539 | 3749447 | 6 | | TTGGGTGTTTGCGCACAAGCAGCCAACC | 0.003773209 | 0.006991449 | 6.66E-06 |
| 1391 | 3750115 | 1 | | GGTCTCGGGAAAATGCTGCCCGCGACAACCCACTGCGGGACCCTAAATGTCTCGACAATAAGGCCTCCTCGGCACGTCTCTG | 0.013302264 | 0.009082288 | 7.05E-06 |
| 2004 | 3750596 | 7 | TMEM97 | TGCCAAGCATCAACGTGAAGAGACCCTCTATGCACACAGTGGATATGTTATGCCTGGCTGTAGCCACCTTCTCTTCTGAAAACAAGATGGGAATGACGGAACTGTATTAAAAGATTAAGTTATCCACTAGGGAGCATACTAGCACACTTCCAGATCAGCCTTGAGATGCTAGA | 4.69E-05 | 0.010906008 | 6.44E-06 |
| 1071 | 3751077 | 4 | C17orf63 | TTACAGGCATGATCCGTGATGGCTGTCCAGTTTCTAGTATCTTTATATGTGAAAATGGGGCTGATGATACATACCCAACCTATCTCAAAGGGCATCTTGAGAAGATGGAGAGAGAATCATGTGAAAAAGCACTTTGAAAATTGTAAAACTCCCTACAAATGTAAGATATTGTTAATGACCTTACAAAAACCACCTTTTTAAAATGATTTGGAATCATAGACTCTAAAAGTTGATTCTAGTGGTCTAGTCCA | 0.000645623 | 0.008905467 | 3.00E-06 |
| 1286 | 3752264 | 9 | EVI2B | TGGGTCAACCAACACAATTCAGCGACACTTTTTCTGGACAATCAATATCACCTGCCAAAGTCACTGCTGGACAACCAACACCAGCTGTCTATACCTCTTCTGAAAAACCAGAAGCACATACTTCTGCTGGACAACCACTTGCCTACAACACCAAACAACCAACACCAATAGCCAACACCTCCTCCCAGCAAGCCGTGTTCACCTCTGCCAGACAACTACCATCTGCCCGTACTTCTACCACACAACCACCAAAGTCATTTGTCTATACTTTTACTCAACAATCATCATCTGTCCAGATCCCTTCTAGAAAACAAATAACTGTTCATAATCCATCCACACAACCAACATCAACTGTCAAAAATTCACCTAGGAGTACACCAGGATTTA | 2.99E-05 | 0.012105796 | 6.65E-06 |
| 1519 | 3752342 | 5 | RAB11FIP4 | CTCATTCGGAGATGCCTGCCTTCTGGGAACTGCTCACCTGCTATTTCATTGGGAGCCTCTCCTACCCCCTTCACCCCCTCCTTACCCATACCTAAAACATATAAAGTGAAATTGCGAAGTCTCCTCAGAACAGAATCAGTTGTGAAAAACCTCAGCATAACGGGCTGCCCAGATCGGGGACTGCCAGATACCTA | 0.00401772 | 0.006569666 | 5.67E-07 |
| 66 | 3755466 | 5 | LASP1 | GAATCACAAGCTGTCGCAGGTTTTAAAAACAGAGACACTGAAGAATGGACGGGTCACGCCCAGGACGGATGCGATGCCGTGGAATGTGCTGAAGACAGATGGGGCGCTGCGGGTTCAGATGGCCTCCACGTAGTTGGCCGGCAGCATCCCCGTGTCGCCGGTGCGCTCCACCGTCCCGTACATCCAGCCGTCGTCGATCTGCTGCACGTT | 4.43E-06 | 0.036109365 | 2.80E-05 |
| 65 | 3755470 | 6 | | CCAGGAGAAAGATTCACTTGTGGTTCAAGTCAAATGTTCAGAATCATAACAGGCCAGAAAGGTTTGATCCCGAGCACAAGCCCACGAGGGAGGGGACCCAAAACAGACCAAAATGAGACAACAACCCCATATAAAAGATGAACTGGCGGCTTCACAC | 4.15E-06 | 0.044191091 | 5.33E-05 |
| 1013 | 3755539 | 9 | PLXDC1 | TGTCTGTCCCGGAAATCAGCTCCTCCCAGCATCCTGTCAAAACCGGCCTATCGGATGCCTTCATGATTCTCAATCCATCC | 0.001501439 | 0.007489452 | 3.31E-06 |
| 1863 | 3755856 | 2 | IKZF3 | AACAGAACCAGTGCTCCAGGTGTTTTTTAATTTTTAATTTATTTTTATTTTTTTGTATATGTATATATGTATGTATATTTTAGAGGACCAGGGTC | 0.00016045 | 0.007545863 | 2.81E-06 |
| 1375 | 3756091 | 1 | | ACGACTCCTAGCATCTTCGGGAGGCTCCTGAAGGACTGAAGCAAAGGAAATCTCTGAAGGGATTAGTCCTTGAAAGGGAGTAGGGATACTTAGGGTGTTCTGTGTTGAGCGCTTCTTCCTATCTCTCCAGCTTCATGTATGTGTGTCTTTATGTCCAAGCAATTGAGCC | 0.006167603 | 0.00745408 | 3.32E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AACAAGTCCTCAGAATTCCTTGTGAAAA AAACGTTTTTTTTTTTGAGACGGATTCT CACTCTGTCGCCCAGGCTGGAGTGCAAT GGTGAAATTCAGCTCACTGCAACCTCCG CCTCCGGGGTTCAAGCGATTCTCCTGCCT CAGCCTCCCGAGTAGCTGGGATTACAGT CACGCGCCACCACGCCCAGCTAATTTTG TATTTTTAGTAGAGACAGGATTTCTCCTT GGTCAGGCTGGTCTGGAACTCCCGACTT CAGGTGATCCGCCCGCCTCGGCCTCCCA AAGTGGTGGGATTACAGGTGTGAGCCAC CGTGCCCAGCCCTGAAATAGTCTTAATT GCTTGTTTTTCTTTTTGTCTGAGGTGTG CTTTTTAAAATCTCTATGGAGATGGAGA AGACTGACATTCTCTGGCCTGATGTGAA AACCTCTC | | | |
| 268 | 3756105 | 7 | MSL1 | TCTGCTAAAAGGATGAAGCCCAATGAAG GAATACTTGAGAAGTGATGTGATACAAG GACATTTATACAGGTTTTGGCATGCCATC CCAAATACTAAGTGCTTTTGTTTACAGCT GTAACTTGTTCTGAAACTAACCATCCCC ACTTTCTTTTCCAAAGATTTTGGTTTTTG AGCAGTAAAGAAATTGTTATCCATTAAC TGAAAAAATAATCACAGCCAAACATCCC TTCCCACATGACTGTATCACAGAATAGT TTCAAATGAACAACTATCTTTTCAGACA GTTATCTACCAACTCTCCGATGTCTTTTC TACTCTGTGAAGATGGCTTGCTTCATCGC TTCACTTGTCATTCCTCTTCTGGTCCTAA AGCTCATGGTGAGGTTGTTTGTTTTATTT TAGGGTTAAAAATCACTATACCCACTAT AAGGAGGGTGTACCAGGGTGAGAAGAG TGCCATGCAGGCACAGCTCTAAAGGAAG GGGCTGCTTCATCTTCCACATGTCTAATG AAGAGAGCCCTTTTACCCCTTTAACATA GGCAAATGTATAGAAACAGACCCCTGAA ACTTCTGAATCTGCCATCCTATAGCTTTA GCTTGAGAGCCCATTTCC | 1.95E-05 | 0.015854797 | 1.50E-05 |
| 151 | 3756196 | 9 | TOP2A | CAAGGGGGAGAGTGATGACTTCCATATG GACTTTGACTCAGCTGTGGCTCCTGCGG CAAAATCTGTACGGGCAAAGAAACCTAT A | 1.82E-06 | 0.028647724 | 1.83E-05 |
| 1556 | 3756197 | 9 | TOP2A | CTGGTGTCTCTCAAAAGCCTGATCCTGCC AAAACCAAGAATCGCCGCAAAAGGAAG CCATCCACTTCTGATGATTCTGACTCTAA TTTTGAGAAAATTGTTTCGAAAGCAGTC ACAAGCAAG | 0.008619147 | 0.0072412 | 3.45E-06 |
| 54 | 3756230 | 9 | TOP2A | TAATGCTGCGGACAACAAACAAAGGGA CCCAAAAATGTCTTGTATTAGAGTCACA ATTGATCC | 8.74E-07 | 0.053313237 | 6.05E-05 |
| 1206 | 3756234 | 2 | TOP2A | GTTCTTGAGCCCCTTCACGACCGTCACC | 0.003465953 | 0.010570624 | 8.22E-06 |
| 63 | 3756235 | 2 | TOP2A | TTCAAGTGGAGCTCTCCTAACCGACGCG CGTCTGTGGAGAAGCGGCTTGGTCGGGA GTGGTCTCGTGGGGTCCTGCCTGTTTAGT CGCTTTCAG | 3.94E-06 | 0.043172399 | 4.70E-05 |
| 1434 | 3757088 | 9 | KRT15 | AGAGGTGGCCTCCAACACAGAAATGATC CAGACCAGCAAGACGGAGATCACAGAC CTGAGACGCACGATGCAGGAGCTG | 0.008028233 | 0.00842142 | 6.04E-06 |
| 1203 | 3757100 | 9 | KRT15 | GGTGGAAGCCGAAGTATCTCAGCTTCTT CTGC | 0.000689814 | 0.009508723 | 9.53E-06 |
| 577 | 3757573 | 4 | ZNF385C | AGGCCTCCAACTCCAACAAGAAGTGTAA GCGTTACTTCAACGAGCACTGGAAAGAG GAGTTTACCTGGCTGGACTTTGACTATG AGCGGAAGCTGATGTTCTGCCTCGAGTG CCGCCAGGCCCTGGTACGGAACAAGCAT GGCAAAGCCGAAAACGCCTTCACTGTGG GCACAGACAACTTCCAGCGC | 0.00240984 | 0.008390462 | 4.38E-06 |
| 196 | 3757645 | 9 | KAT2A | GCACAAGACTCTGGCCTTGATCAAGGAT GGGCGGGTCATCGGTGGCATCTGCTTCC GCATGTTTCCCACCCAGGGCTTCACGGA | 7.65E-07 | 0.020633913 | 2.39E-05 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 214 | 3757985 | 9 | PSMC3IP | GATTGTCTTCTGTGCTGTCACCTCGAATG AGCAGG GAGCAGCTGGCGCAACAAGGCAAGATC AAAGAGAAGATGTACGGCAAGCAGAAG ATCTATTTTGCGGAT | 0.006245159 | 0.015412602 | 1.46E-05 |
| 464 | 3758792 | 2 | TMEM101 | AGGGGCAGAAACAGTACCGGCTCTCTGT CACTCACCTTGAGAGTAGAGCAGACCCT GTTCTGCTCTGGGCTGTGAAGGGGTGGA GCAGGCAGTGGCCAGCTTTGCCCTTCCT GCTGTCTCTGTTTCTAGCTCCATGGTTGG CCTGGTGGGGTGGAGTTCCCTCCCAAA CACCAGA | 0.002047903 | 0.009826673 | 1.07E-05 |
| 1998 | 3758943 | 2 | ATXN7L3 | CGCCTGGCATTACCGCATGCTGGGGTCA TTGGGGGAGGGGGTGGGGCTCACGCTG TCCTGTGGTCTTGAGATTTTTATTTTTGC ATATGTAATCCATTCTGTACAG | 0.002162534 | 0.007948762 | 3.78E-06 |
| 1178 | 3759233 | 4 | GPATCH8 | GGGTGACTTCACTAAGTCCTGAGGAGGG AGGAATAGATATTACCAAAGATAGGAG ATACTGATGTATACAAGGTAATTGCAGT TGACAAAGAGTAGGTGTGGCTAATTGGA GCAGATTATGTCCATGGTGTAGTGGATT TTATGCGTTTTTTAACAGAAGAAACCAC CTCAATTTTTTTTTTTGAGGTTAAACTT CAGTATATGAAAGAGGGGGCAACCCAG CAGTTGTTTTGATTGAAGCAGAGTTCTA GGTCTCCAGGAATAGTTTAAAAACTGTA ACTAGGCTGGGCACGATGGCTCATGCCT GTAATCCCAACACTTTGGGAGGCTGAG GTCGAAACATCTCTTGAA | 1.09E-05 | 0.00904615 | 6.29E-06 |
| 872 | 3760226 | 1 | | CCTGCCATTTCCTCGCATGTAATTTTTA ACACTCATATCTCAGTGGGCTCTTAGAG GTAATCCAAGGTAAGAACCACCTTTTTA GTTAGGTCTGATGGTTAGAAAGCTTGAG TTGAAGCGTGCCCTTCTGGAATTGCCACT TTGGGCCCAATTTTGTCTACACGGGAAC TGCTTA | 0.032732293 | 0.00868694 | 6.90E-06 |
| 178 | 3761459 | 2 | HOXB7; HOXB9 | CGGTGGCTGTCGTGAAATTGTGCTTGTGT TTCGTGATTTCTTTGGGGGTGATTGTCTC GCTTGTTTTCAGTTGTCGATTATATGGGA GGGTTCTGGGTGGGAGTGGGGAGGGCG AGGGGCCTAGAGCTCTAATTGTT | 0.023754148 | 0.016255176 | 1.79E-05 |
| 75 | 3762200 | 2 | COL1A1 | ATTATTTTGATTGCTGGAATAAAGCATGT GG | 0.000102339 | 0.036754271 | 4.77E-05 |
| 438 | 3762201 | 2 | COL1A1 | TTCTAAAGGTGCTATTTAACATGGGAGG AGAGCGTGTGCGGCTCCAGCCCAGCCCG CTGCTCACTTTCCACCCTCTCTCCACCTG CCTCTGGCTTCTCAGGCCTCTGCTCTCCG ACCTCTCCTCTGAAACCCTCCTCCACA GCTGCAGCCCATCCTCCCGGCTCCCTCCT AGTCTGTCCTGCGTCCTCTGT | 1.26E-06 | 0.020791186 | 1.69E-05 |
| 67 | 3762203 | 2 | COL1A1 | GACAATTTCACATGGACTTTGGAAAATA TTTTTTTCCTTTGCATTCATCTCTCAAACT TAGTTTTTATCTTTGACCAACCGAACATG ACCAAAAACCAAAAGTGCATTCAACCT | 0.000124394 | 0.038573659 | 5.08E-05 |
| 76 | 3762204 | 9 | COL1A1 | AGTCACACCGGAGCCTGGGGCAAGACA GTGATTGAATACAAAACCACCAAGACCT CCCGCCTGCCCATCATCGATGTGGCCCC CTTGGACGTTGGTGCCCCAGACCAGGAA TTCGGCTTCGACGTTGGC | 2.02E-05 | 0.035560963 | 4.53E-05 |
| 1456 | 3762206 | 9 | COL1A1 | AGCTGACCTTCCTGCGCCTGATGTCCACC GAGGCCTCCCAGAACATCACCTACCACT GCAAGAACAGCGTGGCCTACATGGACCA GCAGACTGGCAACCTCAAGAAGGCCCTG CTCCTCCAGGGCTCCAACGAGATCGAGA TCCGCGCCGAGGGCAACAGCCGCTTCAC CTACAGCGTCACTGTCGA | 4.39E-05 | 0.014078043 | 9.84E-06 |
| 324 | 3762208 | 9 | COL1A1 | AGCGCTGGCGACTTCAGCTTCCTGCC CCAGCCACCTCAAGAGAAGGCTCACGAT GGTGGCCGCTACTACCGGGCTGATGATG CCAATGTGGTTCGTGACCGTGACCTCGA | 1.53E-05 | 0.025263426 | 1.75E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 746 | 3762212 | 9 | COL1A1 | GGTGGACACCACCCTCAAGAGCCTGAGC CAGCAGATCGAGAACATCCGGAGCCCA TGAGACAGGCGAACAGGGCGACAGAGG CATAAAGGGTCACCGTGGCTTCTCTGG | 3.75E-05 | 0.013541175 | 1.07E-05 |
| 80 | 3762238 | 9 | COL1A1 | TGGGATTCCCTGGACCTAAAGGTGCTGC T | 5.32E-05 | 0.027867168 | 2.65E-05 |
| 1224 | 3762257 | 9 | COL1A1 | GGTGCTCGAGGATTGCCCGGAACAGCTG GC | 0.000120755 | 0.013331704 | 1.14E-05 |
| 686 | 3762258 | 9 | COL1A1 | AGCTGGAAAACCTGGTCGTCCTGGTGAG CGTGGGCCTCCT | 9.74E-05 | 0.014149484 | 1.04E-05 |
| 703 | 3762268 | 9 | COL1A1 | CCTGCGTACAGAACGGCCTCAGGTACCA TGACCGAGACGTGTGGAAACCCGAGCCC TGCCGGATCTGCGTCTGCGACAACGGCA AGGTGTTGTGCGATGACGTGATCTGTGA CGAGACC | 5.08E-05 | 0.018236337 | 1.83E-05 |
| 2076 | 3764125 | 2 | SRSF1 | ACATATCTGAAGAGATGGATTAAGAATG CTTTGGATTAAGGATTGTGGAGCACATT TCAATCATTTTAG | 0.000628393 | 0.007325163 | 4.57E-06 |
| 1510 | 3764880 | 5 | CLTC | TGCTCCTGAATGGAATGGTCCCACAGAA AAAGCACAGGATACAGCACAACATAAG GGCACCTGTTACATATGAAGTGAGCAAA ACATACTAGCATTTTCTATATGCATAATG GGGAAACCTGCATAGGTTAGAGGGCCTT TTACGCTCATTTAAAAATCAGGCAAGTT GTCTGTAACATTTTTCAATAATCTGGGAA GCACTGCAATCCAGTGTACGATGTGCTG ATTAGTGTTGTCTTTGTTGGCACTGACAG TCTTGCATGGTCATATGCCAGTGTTTTTG CTTTAGCTTTTCTTTGAATAAAACAGATT TAAATGCATTTAGACAATACGTATTTGT AAGCTGTTTACATACACTAAATTTAAGA GATTCAATATTAGAGTTTCTTTGTTTCTT TAAACACTACAGAGTGCAAATCAGGTTC TTCACAACAGATTGAATATTGAGCAGTT CTTTAAAGAAAGAGGGGGAAGAAAAAA AGCCCAAGTGAATAAAACATTGAAACTA TTCCCCTTCGAAAATAAATTCTAAAATG ATGTGGAATGTGAAATAAGGTTTTAACA TAGGTGATCCAAGTTTATAGTTAGAAAC AAAAAGAAGTCCTTCATGAAATAAAGGT TACAAGAACACGTTGCCTGTTTTCCCCCA TTATAAACTGAGAAGTGGGTAAAGACGA TGTTTCAGTACGAAAATAGGTGACTACA GGATCAGCGCTTCATCTCACATGCTGTA CCCAAAGCCAGGCTGTGGCTGTCCATAC GGTGGTGCGGTATAACCATAACCAAAAG GTGCCTGGGGAGGGACGGCAACACTGG GTCCTGCTGTCAGCATCAACTGGGGCTG ACCTACAGTAGAAGAAAACAAAAAGGA GCAGGGGCAGGGGCAAGGAGGCAGGA CAAACTGTTAGCATTTAGAACACTCCAA TCTCCTCCACTCTAGCAACATAATCTCAA CCTCAAATGAGTTGTATGGGGGGCACAT TTGATTGCTACAATTTTAGCATGACAGTC TTACTCTAAGAAGGTTCCTACCTAAAAA GCCAACAAACAGTGCAGGGCAAAGGC CAGAACTGCTTATGACTGAACACCGTAT GCCTGACACTCTGTATA | 0.000142667 | 0.010897302 | 5.34E-06 |
| 1369 | 3765948 | 5 | TLK2 | TTTTAGCTGTAACAATTAGAAGGAGAAA AGTTGACAGTTATTGAGATGTAGAAGGC TGTGGAAGTCAGGCACGGTGG | 5.31E-05 | 0.009267069 | 3.83E-06 |
| 1240 | 3766160 | 1 | | CCTCCCAAGAGGATGGCTGTTAGAATG GACTCTGAGCACCTTCTCTTCTATGTGGG CCCTCTCTTCATCACAGGGCCTTCCAGAC ATGATACCTGTTATCAGTGCCCCATCTTA TTCCTGAGAATGGAATAACTCAGCTGCC AAGACTCCAAGCTCCTCCAACTTGTTTTT AAAGCTGAAAGAGGGTGACTCCATTCCC CGCTGGTTCGCCTACCCATTCCCAGCCG | 0.000402054 | 0.009821347 | 6.87E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1283 | 3766835 | 6 |  | ACCGCAGGGGAGTTTGGCCACCATGTGC ACGTGCGTACTGTGTCTGCCTGCAGTTA CAAGCCCGAACTGGAATCTTCCTTCACA CATCTGGACCAAGGTGAAAGACTGAACC TGTCCTGCT | 0.015281883 | 0.006658549 | 3.35E-06 |
| 860 | 3767533 | 1 |  | GTGCTCTCCTCTGGTTACAAGCTCAGGCC AACTCCTAAAAGCCAAACT | 0.000306094 | 0.006888914 | 3.37E-06 |
| 326 | 3768673 | 9 | ABCA8 | GTTGAGGAAAACATAACATCACTTGTTA AACAGCACATCCCTGATGCCAAATTATC AGCCAAAAGCGAAGGAAA | 0.00659163 | 0.009956292 | 7.56E-06 |
| 458 | 3769694 | 4 | AC007639.1 | TCAGGCGGGTGGCAAACAAACATCACAT AAAGGAGAGTGTCTGGCTTGTGTCTTCT GGGTACGTGATCCCCCTGACTTCAGTGT GAGAATGTGGCCAGAGCGTCTGGGGAA GACAGGGAGAGTTGTCAGAGAGGAGTTT TGAGGAGGCCCTGAAGGCTCGCCGGCTG TTAAGGCCTGAGCTGTAGTGGGCAAGAA GAGATGGCCAGTTCAGGTAGAGGAAGCC TGCTTTGAGCTGAAGACCGGAGGTGAAT CTGGACAGGGCTTCCC | 0.000547163 | 0.009413625 | 2.22E-06 |
| 1170 | 3770533 | 4 | C17orf28 | TCAGGCCAAGCAGTCCCAGTTCATGTGT CTTGTGATCTTGGTGGGAAGGTGCTTGA ACTCCCAGAGTTCTAACTTCTGCAGCTA AAACACAGGACCCTAGCTGCCTTCTCAC CCCAGCTAGTGGCAGGCCTCAGTAAATG ACAGAACAGTGGAATGCTCCTC | 0.000357766 | 0.007280479 | 2.38E-06 |
| 197 | 3770609 | 9 | HN1 | CTCTGACTGTCCTGAACGCTGTCGTTCTG TCTGTTTCCTCCATG | 0.002303775 | 0.025254776 | 2.62E-05 |
| 142 | 3770610 | 9 | HN1 | CGTGCCTGCTGCGCCTGTGCCCAGCCCG GTGGCCCCGGCCCCAGTGCCATCCAGAA GAAATCCCCCTGGCGGCAAGTCCAGCCT CGTCTTGG | 2.02E-05 | 0.021529189 | 1.88E-05 |
| 402 | 3770724 | 2 | SLC25A19 | CCAGCTGCCCAAGCGGGGTAGCAGCCT TGAACCCAC | 0.000228432 | 0.011282404 | 7.12E-06 |
| 1014 | 3772175 | 5 | AFMID | GGTATACCAGCGACCGCTGTGCCTTTAG CCAGCTGGCAGCCTTAAGGGGAGATGAG GTCCCCCAAACGAATTCAGTTAATGCCA TCATGGGCACCACTCCCACAGCAGTTAC GACCAGGGGAGGCC | 0.007582294 | 0.006943524 | 2.20E-06 |
| 1763 | 3772574 | 4 | CYTH1 | CACCTATAATGAGCTGGACACTCTATGG GCCTTGCAATTTAGACATGAATAGAGTT CTCAGGTACCTTACATTCTAATTAGAAG GAGAACTTTGACCTCTAACCAAGACCTG TTTAATTCATAGGAGGGTTTCTTTTCTTT TTTTTAAACTGCACTCACGGTCATCCCCC CAAAGGATGAGGGTTTCTTAAGTTATGT TGAAAATTCAAACCTTGAGTCCGGGCAT GGT | 2.15E-05 | 0.008498103 | 5.41E-06 |
| 1351 | 3772842 | 9 | RBFOX3 | TGCCGACCCGTACCATCACACCATCGGG CCCGCGGCGACCTACAGCATTGGAAC | 0.004426107 | 0.006930221 | 4.64E-06 |
| 1862 | 3775861 | 9 | TYMS | CTCTGCCAGTTCTATGTGGTGAACAGTG AGCTGTCCTGCCAGCTGTACCAGAGATC GGGAGACATGGGCCTCGGTGTGCCTTTC AACATCGCCAGCTACGCCCTGCTCACGT ACATGATTGCGCACATCACGGGCCTGAA | 0.003071703 | 0.008057605 | 3.71E-06 |
| 1836 | 3775862 | 9 | TYMS | GGAGATGCACATAACCTGAATCACA TCGAGCCACTGAAAATT | 1.38E-05 | 0.009694831 | 4.94E-06 |
| 1754 | 3778001 | 9 | KIAA0802 | GGACCGCGCTAATAAAAACTGCCGAATC CTGCAGTACCGTCTTCGGAAAGCCGAGC AGAAAAGCCTGAAAGTGGCTGAGACGG GTCAGGTGGATGGTGAGCTTATTCGAAG CCTGGAGCAGGA | 2.89E-05 | 0.0068828 | 3.01E-06 |
| 1295 | 3778069 | 9 | KIAA0802 | TCTCCAGGCCCGAGAGACCAGCAAACCG TCGCCCTCCGTCCCGTTGGGCCCCACATT CCCCCACTGCCTCACAGCCTCAGTCACC CGGAGACCCGACGTCCTTGGAGGAGCAT G | 0.000663296 | 0.006827917 | 4.67E-06 |
| 1540 | 3779045 | 5 | FAM38B | GTTTGTTGAAAAGACGCCTCCCAGACTC TTCACTCACGAAGTGTG1TACAAAAACT | 8.85E-06 | 0.006719053 | 3.01E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CTCCCGGCAACTGTCCTGACCCTCACCA ATCACGCTACAG | | | |
| 661 | 3782809 | 1 | | AGGGTAGAATAACATGGAAAGCAGCTTT TATTCACTCCAAGGACAGCTAA | 0.020732462 | 0.009591141 | 7.34E-06 |
| 1061 | 3784854 | 4 | FHOD3 | GGGCAGTAGGGTCTTGTGATTCCAAGTC ATGTTCTATGGGCCCCACCATCCAGGAA TGCAAGCAGATGAGGGCAGGCAGCAGC CAACTGGCTGCTTCGGGCTCATAGCCCA GAACCCAACAGGAAGTGTTGAGTGGTGG CCTGCCCTAGGACCGACTCCATGGGTGT GTAACGAGTGTAGTTGCACAGGGCCCCA TATGCAGAAGGGGGCTCTGCACTTGGAA TTTAATGCTATGTGGCTATAGTCCTGAAA TTCTTAATTTTATTTTTGAAGTTGTGTCTT TTAAGCAAAGGCCAACGGGACAGTG | 0.00010346 | 0.009326947 | 5.90E-06 |
| 1665 | 3784859 | 9 | FHOD3 | AGAAGCACAGCATCATCCTAAGGACGCA GCTGTC | 0.024456705 | 0.007280018 | 5.36E-06 |
| 1740 | 3787462 | 8 | ZBTB7C | TCTGCCAATGTGAGAAGAGTCAGGAACA GGATTTAGAATATGGGCAACCTTGGTTC CT | 0.002951948 | 0.006763521 | 4.40E-07 |
| 986 | 3787934 | 6 | | ATAATCATATTATCTAAGGCAGAAGTGG TGGTTACTTGGCAAGAATACGATTTCTTT TAATG | 0.001628328 | 0.015025107 | 1.58E-05 |
| 314 | 3788043 | 1 | | TGGGAACCAAAGAGACTAGAACCTGCCA TTTTGTCTCATGCAAGTAGCCCATCCTGC ACTGTCCCGGGAAGCCCCACAGCCCGGA TGGCCCTCAGGGGAGCCTCGCGGCCCTT CACCGTCGCGGGAAAAGCCAAGTTGGTG GCAGGAGGAGCCCACCACCAAGGCGAT CTCACTGCGGAAAAACTCGACCCTCCGC CTTCACGTCTAGGGCGGCAGGTGGTAGA GCTGGGCCTCTCAGGCCCATGCCCGAGG GCAGGCGAGACAAGGAGCGCCCCCAAG TGGCCATGCGGTGTCCTCACGGAAGGCA GGGAGGGCGTCACGGGCCTTGGGGACCT TGACACAACCTGGAGCACGAGGCTGAGA AACCCACCACGCAGGCCAGCTGGAGGCT GCCGCCCAGCCGGGAGTCAGAAGCTGGA GCCACTGGGTGCTCCCGAAGCCAT | 0.001628328 | 0.011501453 | 7.55E-06 |
| 1431 | 3788695 | 9 | DCC | TCCACTCTGGAGAGGTCGCTGGCTGCAC GCCGAGCCCCCGGGCCAAGCTCATGAT TCCCATGGATGCCCAGTCCAACAATCCT | 0.000802243 | 0.007942304 | 3.46E-06 |
| 709 | 3790001 | 4 | NEDD4L | CAGAACAAGTGCATCTGCTGGCAGCCAG CTTAAGGAGTTAGCAGCCCTCAATTCCA ATAACGAACGTGTAAATCAGAATTC | 0.002951948 | 0.008086304 | 6.49E-06 |
| 623 | 3791665 | 5 | BCL2 | GTCAGAGCGAATGGGGCCACATCAACAG AAAGAAGACCCTGTGACCATGGAGAAA CCACCAGTCACAGGACCTTCCCCATCAC CCCCGCCCCCGCCGCCCTGGGCACTGTG CAAGGCTGGATCCCAC | 0.007675909 | 0.012378141 | 1.24E-05 |
| 260 | 3794316 | 5 | ZNF516 | GGCCAAGCCTAAGTCCGTCCCTCTCCGC CCACGGGCTTCTCCGAGGCCATCTCCGA AACGCCCTGCAGCTGCTGGCAGAGCCCG CATGGGCCCCTATGTGGCCCCTGGACAG ACCGACGGCACTCCTGG | 1.63E-06 | 0.017848595 | 1.49E-05 |
| 1612 | 3794399 | 1 | | TCTGATGCTAGAGAACGAGAACCGCAGT GCGTGCCCGACACAAAGGGAAGGACAG GGGACACTGGAACAGGGGAGACGACAT GGAAGAAATCTGGGGGAGCCAAAAGCC GCCATGCCGAGAAGGGGGTCGGAGGAG GCGCGGGAGAAAAGCCCAGGGCTGT ACACTCGCATCCCTCTG | 5.57E-05 | 0.007036327 | 2.08E-06 |
| 918 | 3795871 | 5 | TYMS | GGCCCGTGATGTGCGCAATCATGTACGT GAGCAGGGCGTAGCTGGCGATGTTGAAA GGCACACCGAGGCCCATGTCTCCCGATC TCTGGTACAGCTGGCAGGACAGCTCACT GTTCACCACATAGAACTGGCAGAGGGCA TGGCATGGAGGCAGCGCCATCAGAGGA AGATCTGAGGAACCAGCAGAGGAAGAT AAGGAGGGATGGTGGTTTGAAAGACCAC | 0.000413384 | 0.009451406 | 6.52E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AGCTAAAGGCAAAGTAAAACAGGAGAG AAACAGAAGCCAACTCATATGGTGGAGA CCAGGAGAGAGAGCCACTGGGCTGCAGT GATGTCCATAACAGCCTCTGCAGCGATG GCACGGAGCTGAGGGAGACTATCCATCG GTGCAAGGTTTCTG | | | |
| 666 | 3797622 | 9 | LAMA1 | TTTCTAACGGGAAAGCGGCCGTGCAGCG CAGCTCCAGATTTCTAAAAGAAGGCAAC AACCTCAGCAGGAAGCTTCC | 0.000132342 | 0.012744611 | 1.54E-05 |
| 1521 | 3798448 | 7 | RAB31 | GGGGCACAGCCCTTATTGTTAGCTAAAA GTTAGTTTCGGGCCTTCAACCTTTTAGTC TGCAAGGTAACGTCATATTCAACTGCCT AATGTGCCGTTTTTAACCATAAAATGGC AAGTCAATTATGTGGCAATGTAAAATGC TTGCACAACTCCACTGTCATTCTCAGAG ATTTCCATTGGGAAGCCATGCCTACTTTA TATTAACACATGGCTAGGGGCCAAACTC AGCCAGTGAAATGGATTACATATCGGAG TAACACATATACAATCATATTTACACAG ATACACACTCATGCCACACACGAAAGAA AAAAAAAAGGGAGAAGGAACAAATTTT GGAAAACGATGCCAAGGATGCTACACTA CATGAAACTACATGACTTTTTTTAGCAAC AGTAATTTCCAGGCCTTTACATAATATTA CATGGTTATGGTTCAATTATTAGACAGC CAGGAAGTAATCCCGAGCCAAAACAAA GGAAGGTTGTAAAGCCTCATTGTAGACA AGGCCTGAGCATCCACAGAGAAGATACA ATGTTTATGTGAATCCTGGTGTGCCCAA GTGTGATCTACTCTCTTCACTGACTACTC TGAGTGCTGATGAGAATATATATATTAT CCTCTGACTGGCTTGAATAGCTAAGACA ATACAGAAAGGTAACAGAGTGGTTTCAC ACCCTCATGTGCTTCTGAAATAAAACCA TGGGCTCATTAGTGGGTAGCTCACTATCT GTGGCAAAGACTAGACATTTTATGCAAA ACACAACCACTGCAAACCCAGCCCAAAG ATGCAAAACTCTCAGCTAGGATACTTAC CCCTCAGCTAAAAAACCTGAACAGCTAT CTAGAGATAAACCCAGGTTCTCAGGGAA AACTGGATGAGGAAAGGTTACAAAATA AGCCTGCAACTCAGCTGGAAAGAGGTCA CTTCAATTTTCAACTCATTTTTTTTTTTTT TTTTTTTACCTTTGGCAAGGGGTATGATCA TTTCTTGGCCTGCAAGCACAATCATGCC AACCATTAATGTGGACAATGTGGAAAAA ACCCTAAAAATCCCTGCAAAGCCCCTGT CAAGACATCCAAATGCCGCTTGCTAACA GTTTTTGAGGTACCTATTTGGGAGAGCC AAGTGGAACTCTTGAAGCAAAATAAGTG TTTCCCAGCCTTCACATCCTAACACTGTC AATGAACTCTCTTAAGTTGAGTGAAGTG GAAGCGTGCTGAGTTACTGAAGTGCCAG GTCTTTAATCCAATCAGCTCACAACCTCT TTCCTGACTTTTGCGATATAGATTGTCAA TAAAGGTTAGCCGTCCCTTGAATGCTCA TGGCAAAGAAGGTACCAGCTGGCCCTGG CTAGCACACAGCATGATTAACCATTTCT GAGCACCAATCCTAATGTCCTTTAAGAA TCACCCCTAATATAAGCCCTGGCAGGA AATCAGCTGCTTCTTGATCCCAACTTTTT ATGAAAGTTAGAATGGTAATAGAATTTG AATTTTCAGTAGGAATCAGTTCTCTTCCT TTCCATGCTTTTCTTCCTTGACTTCCTTT GGATTCAAACATCTTTAATTGAGCAGAC AGGGAATCTGAAAAGGAAGGTTTTCATC GGAGCCCATTCTCAGTTCCTTGGCATTCT AGGGTCAGACCTC | 0.017588173 | 0.01180553 | 1.14E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 274 | 3799752 | 8 | C18orf1 | GATGCCGCTGGACTTCCTGGCAGAAGCATGGAGGGTCGCTGGCACTCTAGGTCCAGCTATGCCCATG | 0.022526284 | 0.009387286 | 1.00E-05 |
| 1844 | 3799904 | 5 | C18orf1 | GCACGTGAGGGTACATCCAGTCTTCTACCAGCTAATACGTCAGAGACCACATAATGTTAGGCTGGAAGAGACCCTAAAGGTTATATAAACCAATTCCCTTATTTTAGAGCTGAGAAATTTCAGGTGCAAAGAAGGGAGAGGCTATAACATGGTGGCACTAGAATAAGACTGCCGGGTTTGAATCCTGGTGCAACTACTTATTACCTGTGTGATCTTGGGAAAGTGACTTAACCTTTCTGGGTCACAGTTTGGATACCTATA | 1.71E-05 | 0.007083003 | 2.77E-06 |
| 1664 | 3800020 | 5 | C18orf1 | CTCAAAGTGTGGTTGCTAGAACAGCAGCATCAGCATCACCTGGGAACCTGTTAGAAATGCAAATTTTCAGGTCCACCCAGATCTACTGGGAGCTCTGGGCATGAGGCCAGCAGTCTGGGTTTTACAGAGCCATCTAGGAGATTCTGATGTATGTTAGAGTTTGAGAACCCTCTGACCCAAGGAAGCGGTGGTGTTTCAAGAGTGGAAACCTCCAAAAAGAAAATGAATAAACATATAATATTTTCATATTGCCAGCTTCCTAGGCAATCTGATTT | 0.035784134 | 0.007025272 | 3.31E-06 |
| 1187 | 3802335 | 1 | | TCCACCACAATTTGGCCGGTCCAGAGACTGCTGGCATCATTAACTCAGAAACTCAGAGATACAAACGCTCTACTTATCTTGCCGGGCCCTCAGCCAGAAGTCTCCTATAACTCTGCGGATGTTTATACATGCCCTCTGCTTC | 0.002298587 | 0.007497642 | 2.52E-06 |
| 659 | 3803102 | 1 | | TGGAGGGGACCGTATCCTAACTATATTAACTTCCAATTTTCATCGAAAGCCCCACCTGTCTAAGAAGAGCTCCTAGACATTCCCTTTCCCCTTCAACTTGGAGGAATTGGGAATGACAAAGAGAAATTAATCAAAAGAAGAATTAATCTCTCCAATCAGCCTTGGCATTTTCTTTCTATCTTTGATATGTTGTTTTTTACAGTGTCTTGGTTTTCAGAATAAGCTGTTTGTAACTACTTCCTCCACTATATTGTGAGCCTCTGGAGG | 9.78E-06 | 0.012949041 | 5.98E-06 |
| 657 | 3803770 | 5 | DTNA | TCATCCATTCCACTAGACGCCTTAAAAAGATAACCTCTGGCCGTGGAGAGATTTGCTTAGAAGTT | 0.000264928 | 0.011040738 | 1.09E-05 |
| 1159 | 3809977 | 5 | NEDD4L | GTCCGCGCATCTTTACCGATGCATCTCCACTCATATCAGTCCTCACTC | 0.004913892 | 0.007014438 | 2.16E-06 |
| 527 | 3810024 | 5 | NEDD4L | TGACTGTACAGATGGCGAGGCCATCACGGAGACAGATGATTCCAGAGAAAGAACAGTTTCTGATATTTTGACATTCCAGGCCAAGAAACTATGTAAGGACAAACAAAAGATCCTGAATTATACGGCCCCACTAGTGGGTGAAGTCTCACTTCAAGAACATGATGGCTTGACTACATATGCAATAATAAGAGAAGATGAAATCACACTCCAGAGAGCCAGTACACCACCGTGGAAGAAAGATATTTG | 0.000151311 | 0.010952355 | 3.58E-06 |
| 462 | 3810026 | 5 | NEDD4L | ATGACACCCACAAGTGCACGAAAAAGCTA | 0.002571681 | 0.008565392 | 4.49E-06 |
| 328 | 3810046 | 5 | NEDD4L | CCTCTGCTGATACCGGGGAATACCAGCAAGTTTTAACACAACTGAGAAGGAATGAGCCCAGCTCGCTACTTATACTGATGATTC | 0.001233477 | 0.010318079 | 8.37E-06 |
| 249 | 3810508 | 1 | | CCCTGGCTCTAACAGGTTTGGGAGCCAGTTACCTTTCCCAGTTCATTAACCGACTGGCCTTCGCATTAACAGCCCCTCCATCGGGGGTTGCCTTGGAGAC | 0.024859934 | 0.011192154 | 5.93E-06 |
| 538 | 3811176 | 7 | KIAA1468 | TGCTGTCTTTCCTCAGGTAAGTCCATTATATGCATCTAAGTGCTGGGAGGTTTAAATAGCACTTAAAGAATATTCATGAGAGTTCTGAAATGAAGGTTTCGTCTTTAGCTATTGACTGTAGGATTTGTAATTCAAATCATCACAGCATCCTAAAGAAATACTGTGTGAATGGATGCACACAATTCCTACAGAACACACAAACTGATGTCCAAAAGGCACAGAGT | 6.13E-05 | 0.012391652 | 3.65E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | AATGCTGGTGGCTCTTTCTAGTCAGTTAA GAAACAATAAAAAGTCTGCATTATTCTT TCATAATTTAAATACTTAAGTAATCTCCA CTTTATTATTTTATAACAATGACTTCAAA TTTACATTATTTTAAGTACCATTGTAATA GCTTAGTGTA | | | |
| 1296 | 3816342 | 9 | SF3A2 | CACCTGGGCTCCTATGAATGCAAACTCT GCCTGACACTTCACAACAATGAG | 0.002514771 | 0.007861145 | 2.79E-06 |
| 605 | 3816537 | 5 | AC092068.1; GNG7 | CTGCTTGCATGCTAGGAGCTCCCTCCCCA GCAAGGCCCGGGCCAGAGAGAGAAGGA ACAGCCCAGAGCCAGGAGAAAAGGGAG AGTGAGGCTTTTTATTGTGTATGAATTCA CGTGGTATCGACAACTCCACACAATATT AAAACACTGCGAGAAAGTGGGTGCGGC ACACCTGGAATTTTAAAAAAGTCAGAAA TAAAAACAACCAGACATCCCAATGCAGA TGGCATAGAACCTGCTAGAACCACAGGC GGCGGCTGGAAACAGGAGACAGGTCTTT ACGAAGGTTAGATGGGCAGCGGTTCCGT GGACAGAGGAGGAGGCGCGGCTGGCCG GCATATGGCTTCTGTGCAGAGGGCCTGG CCTCAGGCCGTGGACTTTTTAATAAGTG ACCCCTTGAGGAAGGGCGTGGTGGCTCC ACCTCCACCCGGAAGCCCCCCCGGGTCA CTCACGGGCGGACAGGTGTGTGACGGCC CTCTCCTACCTGCCCCAGAACTTGGGCA GGACGGGCTGTTAACTTGGAGATGGATG CGTGGCCTGGAGGCCTAGCGTTGCGCCT CGGACACGGTGGCCGGCCCGTCAAAGGG ACCACGCAGAAGGAGGGAAACAGGAGC ACCTTCCGCCCTGGCCCAGCCGCCCCGTT TATGTCCCCAGAGGCCAGAGGTCGCAGC TGAGCTATCTGTGCTTGGCCTGGGGTTAC CCCTGGGGAGGGTGGGAGAGGGGTGAG GGTTCTGGCTCCTTCCTGGAGAGAGGAG GGCAGGGGAGGCGGAGCTGGTCCGGGA AGGTGCCCAGGTGGGTCACAACAGGGTC GGGGCCTGGCCCGCTGTGGCCCTTCACC TGGCTACTGGTGTCTCGCTCAG | 0.001119544 | 0.006736721 | 5.36E-06 |
| 1513 | 3817492 | 7 | SH3GL1 | CAGGAGACCATGTTCTCTGTCCTCAGGC AGATCCCAGCTGGCCTCTGTCCCCGGGC TGCAAGCTGACAGCAGGCCCGGGAGGC GGTGAGGCCCTCTGCCCTGGCCTTGAGG AGAAGGAGTGCGTGTGTGAGGCGGGGG TGCATTGGCCCTGGAGTAGGGCCAGGGC CCATCACCAGCACCAGGCTGGGAGGGAT TTAAAACCAGGGTCCTATCTCTGAGCCA CCCCATGGGACCCTCGATCCCATCCTG TTA | 0.002242228 | 0.008418791 | 8.39E-06 |
| 1494 | 3818943 | 9 | PNPLA6 | TGAGCTCTACGAGAAGGTTTTCTCCAGG CGCGCGGACCGGCACAGCGACTTCTCCC GCTTGGCGAGGGTGCTCACGGGGAACAC CATTGCCCTTGTGCTAGGCGGGG | 4.60E-05 | 0.008429176 | 4.84E-06 |
| 1088 | 3819244 | 5 | AC010336.1 | AGGAGGCGTGGCTATGGAAGAGGGCGT CTCCGGAGGGGCGTGGTCAATGGCGAA GGT | 0.0207709 | 0.007382382 | 4.02E-06 |
| 1614 | 3819416 | 4 | LASS4 | CTTCAGGGCAGAGATGTTGCTTGTTTTCC CCACCATTTTGTGTCTTCAGCACCCAAAT ACTAAATGAGCATTCTAGGCAGAGGCCA GTATTTGTAAAGGCTAGGATGTGTGAAA CGATATGGTCTGGTGGGAGCAGAGTATC AGTCAGTAAACTGGTGGGCATTGAAGCT GGGCACATCAGCAGAGGCAAGGCTTGA GATTGTGAGAAGCCATTGCTCCTGTGGT TCTCCCTCATCCCCTACACTCATCATGAC TTGAATGTACCAAGGTGTGCAAGGATGC ATCCAAGACCCTTGGGTGAGGGGAAAAC ATGGAGCTGGGGTCTGGATGCCTGGGC CTTCCTAGGACACCTAGTCCCCTTCCATC TGCACCTTGGGGTCTGTC | 0.002453518 | 0.006618225 | 3.85E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1515 | 3819433 | 9 | LASS4 | TACGAGTCCATCAGCAACAGGGGCCCCT TCTTCGGCTACTACTTCTTCAACGGGCTT CTGATGTTGCTGCAGCTGCTGCACGTGTT CTGGTCTTGCCTCATTCTGCGCATGCTCT ATAGCTTCATGAAGAAGGGCC | 0.000142286 | 0.007928883 | 2.25E-06 |
| 631 | 3820347 | 9 | PPAN-P2RY11; PPAN | GTTCGTAAGAAGAACTCGCTGAAGGACT GCGTGGCAGTGGCTGGGCCCCTCGGGGT CACACACTTTCTGATCCTGAG | 0.004924341 | 0.010289222 | 1.17E-05 |
| 1677 | 3821267 | 2 | CNN1 | ACGCCGTGAAAGTGTGGGAGATCCTGAA GACAGAGGGGACGGTGAAAGGCAGGA AGCGGGCATCAGAAGTGCGGCAGGGGT CTCCTGACTGTGGAGCTAGGAAGATACC TGGACACCACCTTCATGCTATGGTTGGG TAAACTGAGGTTCGGAGAGGAGAGGCA AATAGCTGGGGTCCCA | 0.00140662 | 0.006567496 | 3.81E-06 |
| 681 | 3822704 | 9 | CD97 | TGCTGGTTGGACTTTGAGCAGGGCTTCCT CTGGAGCTTCTTGGGACCTGTGACCTTCA TCATTTT | 2.74E-06 | 0.013772023 | 4.92E-06 |
| 1328 | 3823462 | 4 | AC020911.1 | ATGACCTCCGGCTTCCTGCGGGGCTCCA TGTGGTCTGGACAGACACGGAAGCACAG CAGCGTGAGCGCCAGGACCACCTTCATC TCAGCCATTGCAAACGCCTGCCCAATGC AGTTCCTG | 0.032789863 | 0.006785128 | 6.44E-06 |
| 998 | 3824263 | 7 | PLVAP | GCGGAGGTGAATGGCTTCCTGTTCTCAC CTCCGGGTCCAGGCACTGGGGGTGAGGA AGTGGCTGGGAGGCCAGGAGGCTGGAG GAGGGGAGGTGCTGGGGCCCAGGGCTGT GCGGGAGGGGATGGGATCCTGTGGGTAC CTTGGCCCGTGTGCCAGGGTCGGGGAA CGTGACACTAGGTGAGAATTGGGTAGAA AGTGTGTGTGAAAGGGCATGCGTGCATG TGATGTTGGTGCCATATCTATAGGTGTCG TTGTC | 2.71E-05 | 0.013076432 | 1.57E-05 |
| 1874 | 3824338 | 2 | FAM125A | GAACCTTCGCCCTGCAAGGCGTTTGCTA TCTTCAGCCACTGGGCGGAGCTGCAGCC CTGGAGGAGGGGCGGGTCGAGGCTGC GTGGTGATGGGTCTCCGCCCCACGCC CTGCCGGGCAGGGCTGGAGCTGGACAGA AGCCAGTGCCTTTAAGTCATTTGTGTCAA AACCCTCTGGGGT | 0.000385118 | 0.007035401 | 1.60E-06 |
| 1292 | 3824841 | 2 | PIK3R2 | GCGTCCTCAGCTGGCCGAGCATGGTGGC AGCCTGCACCCTTGGCTCCCTTGTCTGGT GCAGCCAGCAGAGCCGCCAGCCTTGGGC GCCCATGGCCCTCCGTGTGA | 0.005543059 | 0.007453355 | 8.22E-06 |
| 652 | 3824886 | 2 | IFI30 | GGCCGGTGAGCTGCGGAGAGCTCATGGA AGGCGAGTGG | 4.52E-06 | 0.017855887 | 1.23E-05 |
| 1377 | 3824888 | 2 | IFI30 | CAGATACACAAAATTCCACCCCATGATC AAGAATCCTGCTCCACTAAGAATGGTGC TAAAGTAAA | 0.003684101 | 0.010168272 | 1.04E-05 |
| 1671 | 3825896 | 5 | PBX4 | ATTCGGATTTAGCAACATGAAGGTCATA GGTGACTCAGCGGAGAGGGAACAAGGT TGGGAGAGAATGTGGAGGTGAGGAGGA AGCGGAAGCAGCAATCACAAAGTCTTT | 4.91E-05 | 0.007660187 | 5.03E-06 |
| 1200 | 3829042 | 7 | ANKRD27 | TTTGGCACATATCCAAGGCACATTAGAA AATTAGAAATCATAAATTACTTTGTAGA AAAATAATCCCTCCCTTCCTTCTGTACAT ACACAAGTATTTCCAAGAACATGGACAA AACCATTTCCCTATCACAAGGTCATTTGA AAACGGACTCAGGACAAACCCATATACG TGTAGCTCTAGGCCAATAACATAAAAAT AACAGTATAATCTATAGAAATTTATAAA AAGGAATAAATGGCAATAAATTCTAACC GAAAGTAACTCTGACCTGGTTTGTGCTG TTAAGTTTTGA | 0.000124059 | 0.007752649 | 1.97E-06 |
| 1212 | 3830127 | 5 | AC020907.3 | CTGCCACTGCGAGGCTTCCACCCATGCT | 0.03121109 | 0.010360673 | 8.51E-06 |
| 896 | 3832101 | 8 | ZNF573 | AGAGGATGGGAAAGCACTATGGGGAGA CCACC | 0.009627872 | 0.008241546 | 3.50E-06 |
| 393 | 3832546 | 9 | RYR1 | TGTGGAGGAGATGTGTCCCGACATCCCG GTGCTGGAGCGGCTCATGGCAGACATTG GGGGGCTGGCCGAGTCAGGTGCCCGCTA | 1.49E-05 | 0.011890674 | 7.57E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CACAGAGATGCCGCATGTCATCGAGATC ACGCTGCCCATGCTATGCAGCTACCTGC CCCGATGGTGGGAGCGCGGGCCCGAGGC ACCCCCTTCCGCCCTGCCCGCCGGCGCC CCCCCACCCTGCACAGCTGTCACCTCTG ACCACCTCAACTCCCTGCTGGGGAATAT CCTGAGAATCATCGTCAACAACCTGGG | | | |
| 1876 | 3832722 | 2 | ACTN4 | GCTTTGTCTGGCCTCACGTGTCTCAGATT T | 3.39E-05 | 0.008349225 | 6.66E-06 |
| 968 | 3832980 | 4 | ZFP36 | CCGCTCAGACCAGCTTGGTGATTTGGAG GTGAAAATGGAACCCGCGACACCCGGCT CTTCGCTCAAACATGGGTGGGGCGGCCC ATGCAAGTGGAAAGTCGGAGAACTTTTC TCAGACCGAGGCTGCCTG | 0.004114217 | 0.010049579 | 4.54E-06 |
| 1284 | 3833496 | 7 | BLVRB | TGCAAGGCCTCAGAGTCTCGGCACGCGC GGGAACCCACTGGCTGC | 0.03685538 | 0.006962699 | 6.88E-06 |
| 443 | 3833552 | 9 | SPTBN4 | ACGTGTCATCAGTGGAGGTGCTCATGAA CTACCACCAGGGCCTGAAGACTGAGCTG GAGGCGCGGGTGCCTGAGCTGACCACCT GCCAGGAGCTGGGGCGATCTCTGCTGCT CAACAAAAGTGCCATGGCTGATGAG | 0.005040635 | 0.011004892 | 3.37E-06 |
| 853 | 3834543 | 9 | ARHGEF1 | GCTTACTGGGCGCTGGTGGGTGGGTGCA GGGTCACCGCTGCCATCTGTGCCTGCC GTCCCAGGCTCTTGCTCCCCATGCTCCTC TGCTGCTCTCTGGGTCTGGCCATTCCTCT CCCT | 0.018924879 | 0.0080258 | 3.50E-06 |
| 1943 | 3835890 | 2 | APOE | CGCGCAGCCTGCAGCGGGAGACCCTGTC CCCGCCCCAGCCGTCCTCCTGGGGTGGA CCCTAGTTTAATAAAGATTCACCAAGT | 0.000524526 | 0.007074782 | 5.65E-06 |
| 1832 | 3837064 | 2 | GRLF1 | CCGGAACATCGTCTAGCTGGTGTTAGGA ATGTTTGCTTAATTTCCAGACTTTTTTTT AAAAACACATCGTGGTTTTTTGAGGCT CCAACCTGATTAGTGCATGGTCAGCCCT CAATGAAGGCTGAGGCATCTCTGACTGA GGTGTTTTTGTTTGGTTTTGTTTTTAAA ATCATGTATTTGCTACAAAGTATTTGTACT TGTCTCAATGGGAATGGTGTAAAAAACA AAAGGCCTTATGTGATCTGTATC | 0.002080741 | 0.007511443 | 5.05E-06 |
| 600 | 3837159 | 9 | SAE1 | GAATTGTTGAGAGGGTTTATGCCCAGAG ACATCCCAGAAGCACTGAACGCACTCAT GCCAAGATGTTAATACCTTTCCTCACTAA A | 0.004749446 | 0.010789705 | 3.01E-06 |
| 310 | 3837244 | 1 | | GCTTGGAGCAAAGGACAAATGTCTCTGG GGAGAAGCAGAGTGTCTGCCCTCGTT ACAGCACAGGAGACAAGAGGAGGGGTG GGGTGATATAGGACAATAGCTGGGGTTC TGGGAATTGCTGTTGGTGTAATTATCATG TCAGGGACAGAGGCTGAATCACCCAGGG ATCTCAGTTGGCTGCCGAGAGGGAACGA TGCTGGCCCACTTCCTGGGGTCAGAGAG ATGAGAGTGGATGGCGGCGGCGGTGGTG TTGCTTCTCAGCCTGTCTGGAAATCTCAG AGCCAATGACCAAAGCGCTGTGCTGCCT TG | 5.29E-05 | 0.013243168 | 9.18E-06 |
| 610 | 3837791 | 2 | GRIN2D | CTTTTTAACGTCACCAGATGGGGCGGGA GGTGGGGGGTTCACGCCACTCCCGCGTC CCACCTCCACGCCCGGGGCCGTGGCCCC CACATCACTGTGCAGCTCCCCGGCCCCA GCCGCGCCTCCGGGAAGCCCGTTTTTA ACCTTTCATCCATTGGGACTCAAAACTGT GAGACGCGTTCGCCAAACTGTGACCCCA GACCTTGGCCCCGCCACACAGAAACCCC TGACCCAGACTGTGACATCCGACTCCTA AAATGGTCATCCGACTCCAGACTGTGAC CCCTGACCCCAAACTGTGACCCGAACCC CAGACTGTGCCCCGACCAGACTGTGACC CTTGACATCAAACCGTGACACCCCTCC TCCTCTTCCACCCTCGGTCGCTTTTCCCT ACTCTGACCTAGGACACGTCCCCAACGG AAGCCCCGCCTTCCCTTGCACCGCGATG | 0.001921299 | 0.009458325 | 6.40E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1271 | 3837819 | 1 | | AACCCAACCTCCCTGAAGCCAAAACTTC CCACCCTGCCGCACCTCCGGACCACCCC ACTTGCCACCAAGCACATCCTCTCCAAA TCCAACCCTTATTTGCGACCCTTCAGTGA CTGGCTTAGTGAAAGGGGCCTCATCCCT GACCCCCACCAGCTTATGAAGGCTTCAT CTCAGGGAACTCTGGACCCCCCATTTCTC CCTCCGTCCATCTCCCCTTTATCACGTTT CTTTCTTTCTTCTCTGTGTCCCCCTCTTTC AGAGTCTCCCGTCCCCCACTGCCAGTCTC CCTGCCCCCTAGTCGCTGTCTCGCTCCTC CGCCGCTGTCTCCTGTCCAGCCTGCCTGG GCTGTGGCCCAGCCGCTCTGCCTGGCTG GCCTCCCTGGCTCCCCCTCTGCGGCTCTG AGCTAGCCCCACCCCCGGCCCCCCTCCA TCCAGCCTCTGATCCATCTGTGGACTCCG AGGTCGGGTGCCCGTCACACGGCCCCTG GGACCAAGGACAGACTACAGCCCCTCAG CACCCACAGAGGCTTCCCCTCAGCCCTA GCCGAGGAGCCCCAGCGGAGGGCATG GGGGTGGGCCGCCCCAACAGGTACGTGC CTCCATGCAAGGCACCGCTGAGCCATCC CCTCCTGCTCTGCTGCGTCGCCCCCATCC ACCCCTGCCCCAGCATCCCTGTCCTCAGC TTGTCCCCTTCAAGAAGGCCTTGTCTTCC CATCAGTGACAGGCTCAGCGCCAGGAGA ATCCACCCCCAGGTTCAGTGCCTCCAAC TCTCACCCCATCCCCATTTTATGCATTTT CTCACTGGCTTCCATCCTTTCAGAGAAAC CCTCTCAGTCTGTCTGTCTCTGTCTCTGT CTCTCTCCCCATCTCTGTCTCTCCCATC TCTCTCTGCCTCTCTCTGTCTTCACAATTT CATCTCCCCATGTCGCCATTTCTTAAAAC ATTTCTTTTCTCCTTTTCGTTTTCCCAATT GCCCTGTCCGCCTCTATCTTCTCTGTCCC CCTCCATCTAGGTCTCTGTCCCCCCCTCT CTCTGGGTCTCTGTCCCCCTCTGTCTCTG AGTCTCTATCCTCTCAAGGTCTCTGTTCC CCTCTCTCTGGGTCTCTGTCCTCTCTCAA GGTCTCTGTCCCTTTCTCTCTGGATCAAT GTCCCTTTCCTGCTGCCCTCTCTGGGTCT CTGTCCCCCTCTCTCTCAGGGTCCCTGTC CTGCTTGGTCCCTGTACTTTTTCTTGGGG CACCCTCTCAACACCCCTCCTCCTGCCTA TCTCTGCATCTCTTTGTCTTTCTGTAGTCT CTGCTTTCCAACCTGCTGTCCAGCCCCCA CCAGTAGGTGGGGAGTGGTGGGGAACA CCCCTGGTTTCGGAAGAGTGAGAGTGTT GATTTGGGAGGGTGAGGGTGGGGCCTGG GGGCGGGGCTTCTTGGCCTCAGATTAGA CAGTGACTTTGACACGAAGTTGAAGCAC CTTAAGCCCTGTATC | 0.030881616 | 0.00909433 | 3.40E-06 |
| 995 | 3840810 | 2 | ZNF765 | GGCATAATTCGCACCTGGCACAACATCC TAGAATTCACATTGGAGAGAAAGCTTAC AAGTATAATGAATGTGACAGGTCTTTAG TGGGCAGTCAACACTTGTTTACCATCAG GCAATCCATGGTGTAGGGAAACTTTACT TATGTAATGATTGTCACAAAGTCTTCAGT TACACTACAACCATTGCGAATCATTGGA GAATCCATAATGAAGAGAGATCATACTA GTTTAAT | 2.12E-05 | 0.009499038 | 5.84E-06 |
| 188 | 3841985 | 4 | EPS8L1 | GGAGACGAAAACAAAGCAGTGAGGCTG GAGGAGACAAAGGGGGGTCTGGGTGAG GGCCCGAGCAGAGGGTCTCAGCAGGGA CAGCGTGCTGGGAGCTGCCGGCCCCACA CAGGGGGTGCCGCGGCCCT | 0.007398176 | 0.018336943 | 1.47E-05 |
| 1352 | 3843632 | 1 | | TACAAAAGGATCAGCCCATGACAGCAGC TGAACAACACTTAACAGGACAAAAGGA AAATAAAAATGCCAGACAAGATATACA GTGGAGGGATGCACATACAAAGAGTTGG | 0.012019459 | 0.006787939 | 6.05E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| | | | | GAAAAAGGAAAAATAATTACATGGGGA AGAGGATTTGCTTCTGTCTCTCCAAGTGA CAATCAGGTGCCTCTGTGGGTGCCCACC AAACATCTGAAGGTCTATCATGAGCCAC ACCAGGAAGAGAGGACTCTGGGAAGAG CCAGAACTCCCTATACGAGTGATGGCAT GAATGAAAATCTCAGAGACAAAGGAAA AGACCAAGAATACTCACCAGGCAGACCC TCCAACATGGGGACA | | | |
| 1789 | 3844578 | 4 | SHC2 | CCCCGGACTCTTGGAACTGCGTTTCTTCCC TCTCACCCATCCTGACCCTAAGAAGCTG AGAGAATCTGTGCCCCTCTTGGTAGACT GGGAAGGCGGGGGAGAAGCCCCTCTGC CCTCGTCACCCAGCAAGGGCTAGTGCAG CCTCACGTTCATGTGGATTCACAGCCAG ACCCTGTTCCAAGGCAGAGGCAGTCTGG TCAGGACCTGCAGAATACACATGGGGT CCAGGCAGCTCCCGAGGGAGATGCCCCA AGGTTACCTGCGATGCTGTTCCGGTTTGA ACCATGTGGATAGTTTTTTTTTTTTTTTT TGGAGACTGAGTCTCATTCTGTTGCCCA GGCTGGACTGCAATGGCACAATCTCAGC TCACTGCAATCTGTGCGTCCTGAATTCAA GTGATTCTCATGCCTCAGCCTCCCAAATA GCTGGGATTGCAGGCGCCCACCACCACG CCTAGCTAATTTTTGCATTTTTAGTAGAG ACGGGGITTCACCATGTTGGCCAGGCTG GTCTCGAACTCCTGACCTCAAATGATTC ACCCACCTCGGCCTCCCAAAGTGCTGGG ATTACAGGCGTGAGCCACCACGCCCGGC CCCATGTAAACACTTTACACGTTCAAAA TACAATTAAAAAAAGAAAGGAAGGAAA ATCCTGAAATAGAACTGAGTCAGAATAA GTGACCCTCCGTGCGTCATGTTGATAGC | 0.002420691 | 0.006584521 | 3.73E-06 |
| 852 | 3844980 | 9 | SBNO2 | CCCACAAGGGCTCAGTGGGCCCAAACCC TTGAAATCCGTGAAACCGGGTGGTCCCA AGAGCTAGAAACTCAGGAAACCCCAGGT GCTCAGGGCCCCGCGTCTCGGGGGCTCC GTGGGGCAGACCCCTGCTAATATATGCA | 0.009627872 | 0.008088964 | 6.05E-06 |
| 564 | 3847993 | 4 | CD70 | AAATGTTCTTGGTTAGGGATGTTTGAAG AATAGAGGAAGTGGGCTGGGCACAGTG GCTCATGCCTGTAATCCCAGCACTTTGG GAGGCTGAGGAAGGCAGATCGCTTGAGC CTAGGAGTTCAAGACCAGCCTGGGCAAC ATAGTGAGACCCCCATCTCTACAAAAAA TACAAAAATTAACCAGATGTAGTGGTGT GCTAGTCCAAGCTACTCCAAAGGCTGAA GTGGGAGATTGGGTAGAGCCCA | 0.019681587 | 0.007379819 | 3.29E-07 |
| 1373 | 3850013 | 9 | COL5A3 | TTGCTGATCACCTTGCGGGGACAGCCAG CCAATCAGTCTGTCCTGCTGTCCATTTAT GATGAAAGGGGTGCCCGGCAGTTGGGCC TGGCACTGGGGCCAGCGCTGGGTCTCCT AGGTGACC | 0.034258318 | 0.006866394 | 6.03E-06 |
| 1935 | 3850053 | 4 | EIF3G | GAGGCTCTTCTTCCCCAGGGCTAACCTA GAGGAATTGGAAAACCGTGCTCCCGGAC TTTGTGTTTAGAGATG | 3.34E-05 | 0.006523882 | 3.13E-06 |
| 1641 | 3850436 | 9 | KRI1 | GAGACATCGTCGCAAAGTTATGTGGAGG AACA | 6.18E-06 | 0.009498748 | 5.51E-06 |
| 523 | 3850559 | 4 | TMED1 | TGAGTTCAGTCTTGATGCCTGCCTGGGTT CAGTTACAGCCCTGCCCTTCCCAGGCGG CCTCAGGTTACCGCCCTGACTGCCCCGCT GAGTCGGCTGGC | 0.001219026 | 0.011207839 | 1.11E-05 |
| 785 | 3851376 | 1 | | CTGGAAGCCTCTTACAGTGCTGGTACAA ACTAGAATACACAAAGGAAGGGATCATT TTATACGTGTTACTGTGCTACTTGTTCTA TCTACTTAGTGTTCCATACATGTAATTAC CTATTCCATCCTATCCCAAAGTACTGAA AATCTCCATTCTACTTTCTCGTCTGTGA ATTTGACTATTCATAGAGAGAGATAT GTGGAAGTATGCATGTGTCCTTCCATGTC | 0.008812862 | 0.010323631 | 5.63E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TGGCTTATTTCACTTAGAACGTTTTCAAG GTTTATCCATGTGGTAGCATGTATCAGG AACTCATTGTTTTGTGTCTGAATAAATT TCCACTGTATGGTTAAAGCATACTTTGTT TATCCATTTTTATGTTGATAAACATGGGT TGTTTCCACAGTAATAATTTGACTGCTAT CAATAAGGCTGCTGTGGATGTGGTATGT CTATGTCTGTGTGAGTCCCTGCTTTCAAT TCTTTTGGATATATGTATCCCTAGGAGTG TAATTGCTGGTTCACAGAATAATTGGTG TAAACCTTTTTCAGGAACAGGTATATTG CTTTACAAAGTGGCTACAATGTTTTACAT TCTCTCCAGCAATGCATAAGGGTTTCTA | | | |
| 1416 | 3851726 | 9 | HOOK2 | TGGACTTTGAGAAAAGCCGAAGTCAGCG GGAGCAGGAAGAAAAGCTGCTCATCAGT GCCTG | 4.98E-05 | 0.008114691 | 5.42E-06 |
| 105 | 3852452 | 9 | RFX1 | AGCCCCAATATGTCACCGAGCTGCAGAG CCCCCAGCCCCAGGCACAGCCACCGGGT GGCCAGAAGCAGTACGTGACGGAGCTCC CGGCTGTACC | 0.000124394 | 0.017123737 | 1.54E-05 |
| 819 | 3852796 | 4 | DNAJB1 | CCGCCTTTTGACAGACAGGGAAACTGAG GCACGCTGGCCCCTCTCGGCGGCCCCCC GGGAAGGACGCCCCGGGCCGTGGGGCC GAGCTGCCCCGCCCTCCGGCCTCGCGGG CCTCCGCCCTCGGATTGGCGGCCGCGCG GTGGGAGGAGGAGCCTTGGCCCAGCCGC TCGGCCAGAAGCTTCTAGCATGTCTGGG GCTGCCCCTCCCCGGGCGCCTCCTCCCGC GGCCCCGAGCAGCCCCGGGGTGCGGTGC ATGGGGGTGGGGGAGCCGGGGGTGACG ACGGGGACGGCGCGGCGGAGCCCGCTG CGGACCCGGGCTCACCTGGGCTCGGCCG CCGGGGTCCGCGGGGCGGCGCCTCCGGC TCAGCTGCGGGGCGAGGGGTTGTGAATG CAGGAGCCGACCCCGTTCGTGGGCTTGG GGGCTGGGTTGGGATAATTCCCGGGAAG TGATGACCTGGC | 0.002849134 | 0.00888026 | 4.00E-06 |
| 1933 | 3852890 | 9 | EMR2 | GGCTTCCTTGGACCTGTCTGCGCCATCTT CTC | 0.029699585 | 0.006995595 | 3.97E-06 |
| 483 | 3853114 | 2 | NOTCH3 | AAGTAGGCACCCTTGGGCGCACCCACTG GGGCCAGGGGTCGGGGGAGTGTTGGGA GCCTCCTCCCCACCCCACCTCCCTCACTT CACTGCATTCCAGATGGGACATGTTCCA TAGCCTTGCTGGGAAGGGCCCACTGCC AACTCCCTCTGCCCCAGCCCCACCCTTGG CCATCTCCCTTTGGGAACTAGGGGGCTG CTGGTGGGAAATGGGAGCCAGGGCAGA TGTATGCATTCCTTTGTGTCCCTGTAAAT GTGGGACTACAAGAAGAGGAGCTGCCTG AGTGGTACTTTCTCTTCCTGGTAATCCTC TGGCCCAGCCTCATGGCAGAATAGAGGT ATTTTTAGGCTATTTTTGTAATATGGCTT CTGGTCAAAATCCCTGTGTA | 0.000126422 | 0.016671556 | 1.24E-05 |
| 1729 | 3853116 | 2 | NOTCH3 | ATCCTTGCCTTGCAGCGTGACCGAGATA GGTCATCAGCCCAGGGCTTCAGTCTTCCT TTATTTATAATGGGTGGGGGCTACCACC CACCCTCTCAGTCTTGTGAAGAGTCTGG GACCTCCTTCTTCCCCACTTCTCTCTTCC CTCATTCCTTTCTCTCTCCTTCTGGCCTCT CATTTCCTTACACTCTGACATGAATGAAT TATTATTATTTTTATTTTTCTTTTTTTTTTT ACATTTTGTATAGAAACAAATTCATTTA AACAAACTTATTATTATTATTTTTTACAA AATATATATATGGAGATGCTCCCTCCCC CTGTGAACCCCCAGTGCCCCCGTGGGG CTGAGTCTGTGGGCCCATTCGGCCAAGC TGGA | 0.003872676 | 0.007830713 | 5.66E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1282 | 3854920 | 2 | LSM4 | GTTGACCGCCCTTCGAGCCCGGTGCTGA | 0.020465161 | 0.008117307 | 7.33E-06 |
| 1165 | 3855225 | 9 | COMP | GTTACACTGCCTTCAATGGCGTGGACTTC GAGGGCACGTTCCATGTGAACACGGTCA CGGATGACGACTATGCGGGCTTCA | 0.010785085 | 0.009827647 | 9.87E-06 |
| 562 | 3855231 | 9 | COMP | GGATCCGCAACCAGGCCGACAACTGCCC TAGGGTACCCAACTCAGACCAGAAGGAC AGTGATGGCGATGGTATAGGGGATGCCT GT | 0.000103742 | 0.016123279 | 1.50E-05 |
| 636 | 3855232 | 9 | COMP | AACTGCCCGCTGGTGCGGAACCCAGACC AGCGCAACACGGACGAGGACAAGTGGG GCGATGCGTGCGACAACTGCCGGTCCCA GAAGAACGACGACCAAAAGGACACAGA CCAGGACGGCCGGGGCGATGCGTGCGAC GACGACATCGACGGCGACC | 0.000674778 | 0.012020397 | 1.25E-05 |
| 1089 | 3855522 | 4 | TMEM161A | CCACATCCTGATCTGAGATCCAGCACCC CAAAACCGAACTCCTCTAGGTCATCCCC AAGGCCTATTTGTGCAGCAGTGCTTGTTC CCTGGAGTTCTGGGGTCCCAGACGGAGT GTGGT | 0.027951183 | 0.008592818 | 4.08E-06 |
| 247 | 3856015 | 2 | AC104523.1 | CCCTCTGACTGAACAGGCGTCTGTGACC TGGCCTCACGACCTGGGACATGCCATCC TCAGGCCACAGACACTGGACTTTGGTCA AGTACTAGCCTCCAGGTGGGGTCCTGGT GCAAGCAGACAGCAACCCCCGAGCCGTG ACTGCGGTTCTCAGTTTGGAGTTTGGTCA AACAACCAATGGGGACAGAGTCTTGGGG TCAGGTCCAGCAGGAACTGCCACCCCTC CCAGGGACAGCCTGTCTCTCCCACTCAC CATCGCTGGTGCCCACGGGCTGCTGACC ACCTGCCAAGTCCTCCTGTCCCTGGACC AGCCTCTCAGGCAGCAGGTCITACCTTT GCCTCCAGGGCACTGATCGATGGCAGCT TTGTCTCACTGTAAGGCAACCCAGACAG AGCTGAGGGCCTGTGCTGGGCCGGGAGC TGTCCTCCTCCTTCCCTAGCAGTCCTAGG GAAGGACCAGCCGTGTCTCTCCCCACCC CACCCCTGGTCTTAGCCCAGGAGACACA CAGGGAAGGTAGGAAGAGGGTCTCCCTG TGGGCTGACGCCTGTGAAGGGACAGGAC CTGGGAGAAGAGGGGTGTGTGGGTGGG GCAGGGACCACTAGGGCCCTGTAGAGCA TGGGCTTGGGCTACACAACAGGGCTGCC CCTCCTGGGCTAGAGGCAGTGCCCTCTG CAGGAGCTGAGAAAGTCCAGTCCTGAGA AAGGACGTGTATGGCCCAGGGTGGGTGA CTGGGCCCCAAAAGCAGTCCTCGAGGGA GTGACCACATTACCAGGCCAGGATC | 8.64E-05 | 0.01488092 | 6.53E-06 |
| 808 | 3856288 | 6 | | CTCCCACGGTGCTGGTATTAGAATCATG AGCCACCGTGCCCAGCAAAAGATGATTT TAAACATTTATTTAGGTGGGTAGGCAAC ATTCTAAGATAATACCCTGGATTACCAG TCTGTTGCACACGTGCTGTGTCATACTTT CCTCTTGAGTGTAAAAAAAATGTGTGAC TGTGGTGGGAAATCACTTATGAAATTAG GTTACTCATCCGTAGACTTTGTGTTTATC AAAATGGAGATTATCCTGATTGTGCTAA ACTTAATCAGAGGTGCTTTTAAGAGAAA GAGACACATCACAGAAAAAACACCCCTGC TGGCCTGAAAGTAAGTGACTTCTAGGTA GAACATGTTGTAAGCTGCTTATGGTGGC CACATGGCGGGAAAAATGTTTGTATCTT GCCATCATTTCTGCCTCCTCCATGTTGCT TCCAGTAAGGAACATAAGAGGATTCTAT GGCAGAGGGAAAAAAAGGGAATCTCA TTCATTCAAGAAATAATCACCTCTCATCT GGGATAGCTTAAGAGAAACAGGAGACC ACAACAGGTCCACATTAATGGGAGGAAA AAGGTAACCTGGGTAAAAGTGCTCACTG GCATTATGGAACAGTATTTAGTAAGCTG | 0.002024742 | 0.010085361 | 9.23E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 782 | 3857807 | 1 | | TAGTGAATGATCAGCCTCTGGGATACCA ATAGTCTACCAACAAGGCTGAACTCATT TTCCACTCAGGTTGCCGGTGATACAGAC ACTCCTTTCAGAGCCAGGAACCACTCTTT TTTTCTGTCTCTCCTCTGTTCTGAAATTTA GCATCTGGGCTTGTTTGATATCCTTGTTA GAGGTCAAGAGCAGGTT | 0.002293409 | 0.007008648 | 1.30E-06 |
| 1348 | 3857937 | 1 | | GGCAGAGGTTCTATGCCTCTGTCCCTGA GAACTTCTCCAGGATCTTGGAAATTCCT GGCCTTCA | 4.98E-05 | 0.008955614 | 5.35E-06 |
| 1095 | 3859962 | 7 | C19orf55 | CTAAGGTTTTTGGTCTGAGCGGCAAAGG ACAGAGC | 2.42E-05 | 0.00991284 | 3.70E-06 |
| 2020 | 3860139 | 2 | TYROBP | GCCCGAATCATGACAGTCAGCAACATGA TACCTGGATCCAGCCATTCCTGAAGCCC ACCCTGCACCTCATTCCAACTCCTACCGC GATACAGACCCACAGAGTGCCATCCCTG AGA | 0.003716277 | 0.008084936 | 7.41E-06 |
| 1533 | 3861561 | 9 | LGALS4 | CTGTCCATTCGCTGTGGCTTGGATCGCTT CAAG | 0.012305161 | 0.008083965 | 4.75E-06 |
| 1288 | 3862193 | 9 | FCGBP | ATGGTCTCCGAGTGGATCTCCCAGCTGA GAAGTTAGCATCTGTGTCCGTGAGTCGT ACACCTGATGGCTCCCTGCTAGTCCGCC AGAAG | 0.020351547 | 0.00902822 | 8.96E-06 |
| 1687 | 3865345 | 2 | PPP1R13L | ATCCCGTCCAAAGTGCCTCCCATGCCTA CCACCATCATCACATCCCCCAGCAAGCC AGCCACCTGCCCAGCCGGGCCTGGGATG GGCCACCACACCACTGGATATTCCTGGG AGTCACTGCTGACACCATCTCTCCCAGC AGTCTTGGGGTCTGGGTGGGAAACATTG GTCTCTA | 0.000579253 | 0.007965781 | 2.31E-06 |
| 956 | 3867149 | 4 | LMTK3 | CCCGGTATCAGAGCTAAGGTAGAAGACG CCACTGGAGGGTTTCACTCCTACTTCCCC AATCTTGCCTGAGTCCAGATATTGTCCCT GCCATTTCTTAGCTGTGTGACCTGGGGC AAGTCGCTTTCCCTCTCTGTGCTTCAGTT CCCTCATCTGTAGAGTGGGAATGATAAC AGGATCTAACTCATGAGATTGCTGAGGG AATTAAATGGCTTAATCCTCCCGAGTAT GCAGCACAGCGCCTGTGCAGCAGCAGTC TCTAACCATTA | 4.32E-05 | 0.008497033 | 5.08E-06 |
| 1370 | 3867534 | 5 | FTL | GAGCAGAGGCTTGAGGGGTATGGTTGGG TAGCCATGGATGCAGCGGGTACGTAC | 0.000617654 | 0.006556618 | 4.97E-06 |
| 1579 | 3867772 | 9 | SLC6A16 | TGTCTTGGTACTGCTCCCTGTTTCATCA TTGTCGGTTTCTTCATCCGGACTCTACTC CTGGAAGGGG | 0.0015655 | 0.007315823 | 5.70E-06 |
| 977 | 3868126 | 2 | PNKP | AGCTCCCCTCCACAATAAACGCTGTTTCT CCTT | 0.001843787 | 0.007146769 | 4.84E-06 |
| 1714 | 3868195 | 9 | IL4I1 | TGCGCGCCGCCATCAAGATCAACAGCCG GAAGGGGCCTGCATCGGACACGGCCAGC CCCGAGGGGCACGCATCTGACATGGAGG GGCAGGGGCATGTGCATGGGGTGGCCAG CAGCCCCTCGCATGACCTGGCAAAGGAA GAAGGCAGCCACCCTCCAGTCCAAGGCC AGTTATCTCTCCAAAACACGACCCACAC GAGGACCTCGCATTAA | 0.041003559 | 0.007474114 | 2.69E-06 |
| 1067 | 3868892 | 3 | KLK14 | AGCATCCTGATCTTTACTCCGGCTCTGAT CTCCTTTCCCAGAGCAGTTGCTTCAGG CGTTTTCTCCCCACCAAGCCCCACCCTT GCTGTGTCACCATCACTACTAAGACCG GAGGCACAGAGGGCAGGAGCACAGACC CCTTAAACCGGCATTGTATTCCAAAGAC GACAATTTTTAAACACGCTTAGTGTCTCTA AAAACCGA | 0.018331444 | 0.008434542 | 8.81E-06 |
| 1063 | 3868997 | 2 | CLDND2 | GAAGACAGGTTCCTCACAGCAAAGCCTG TGGTGAAGGTCTCAGAGGCCTCTGGGG GAAGTCTCAAGGTCTCCAGTAAGGGGAA CGAGGTCTGGAGGGAGGAGGTTGTGGAT CCTCAGGCAGGGTTGTTGAGGGAGGGGG GTCTCCAGGTCCCCAGAAGCAGGGACCT CAGGCAGGAGTACCAGGGGAG | 0.000998659 | 0.006686711 | 1.02E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 648 | 3869569 | 6 | | GCCCATCTGAGCTCTTACCTGTGTTCACA CCTTTGATCCATTCCCTCCCATCTGGATT TTTTTGCTATTTTCCCTTCACTCTCCAGA GTCCAGGGCTCTCCTTTGCTCCCACAT AGAGATAATACTCAGGTCAGGAAGACA GATTCCTGTTTATAAAAAAAGAGAACCA AGGTGTACTGTGGCACCTTTAAAACTCA AGCCCTGGGCTGGGTGCAGTGGCCCAGG CCTGTAATCCCAGCACTTTGGGATGCCG AGGCAGGCAGATCACTTGAGGTCAGGAG TTCGAGACCAGCCTGGCCAACGTGGCAA TATGCTGTCTCTACTAAAATATAAAAA TTAGCCAGGTTTGGTGGTGGACGCCTGT AATCCCAGCTCCCTGGGAGTCTGAGGCA GGAGAATCACTTGAACCCGGGAGGTGGC GGTTGCAATGAGCTGAGATAGCACCACT GCACTCTAGCCTGGGTGACAGAGCGAGG CTCCGTCAAAGTGAAAGAAAAGAAAGA GAGAGAGAAAGGGAGGAAGGAAAGAGA GAAAGAGAAAGAAAGTCAGTCCATGGTT TCCAAAACATACTTCTGTTTCCATTAATT TATTAGGAATGCTCTTCCATCTGGCTGTT GATCTGTGTCCTGTGTAACATCCTTTATA ACAAATGGTACACCTCAGTAAATTGTTT CTCCAAGTTGTGTAAATCACTCTAGCAA TAGCAAATTCTGGGGGCAGTTTTGTGCA ACTGAGCCCTCAGCCTCCTGTGAGATCT AATGCTAACTCCCTATAAATGGTGTCAA ATTGAGTTCAATTAGAGAACACCCAGTT TTTATCTGATGAAAAATAGCTTGTTGGTG GGAAGTAATCCCCACACATTTTGATGAC CGGAGATGAGGCATTCTGTGTTGAGCAT TCACTATTGTGTTGATTGTGAGTAGAAA AAACACTTTGGTTTTTCCTCCTATCTTAT ACACTCACACACCCTACCCCATCCCAGA AGTGAAGATAGTGACCCATACCTGAATG AGTCAAGTCACTGCCTGCCGTCTGGCAG AATAAGGACAGCAAATGGAAGCTAACCT CTGATACCAAGAATTAGGAAATGACAT GCCTTATAGACAGTTTTCCAATTCTCATC TTCATCTGTATATTTTAAACAAATGTGAT GTTTATTATAGAGAAATTAATCATAATA TCCAATCAATTCATCATTCATCTGGATTG AGTGTCCCCCTCTTTCCTCATTACTGTGT GTTTCTCTACCTACCTCTCATTCTCACCT TCTTTTCCTAGCTTTTTTTTTCTCTTTATT TTTCCCCTAGGATTCTCCTCATTTCAAGC CCTTCTTCCTTCTCCTGCTCTTCCCTCTAT TCCTTCTCTTCCACTTGTTCTGCTCCTTTC TCACTTCTTTCACCTCTTATTCTTCTTTCT GCCCAATATTTGTCTCCAATTTTCATATA GTTCTGCCTCTTTCTTCCCCCCGTCTCTG CTGCCCCCTAGCTTCCCCTGTTAAATCCC CTCTTCCCTGCTATATCCACCTGTCCCCT CTCTGGCATCCCCAGATCCCAGTTCTCCC CAGGCTGTGGTTCTCCCTGTGCTCTCCTT ATCACTGGCTGCCCCTCTTGCTCTCCCAG CACCATGCTGCTCTGTCTGCCCTGGCTCC AAATCCCTCCTTCTCTCCCCAACTCTCCA TCTGAGGAGCCTCCCCTTTTCTGCCCCTC TCCCTATCTTGCTGAACTTTATCTCTCTA GAAACCCAGTTTTTCTCTAAATTTCTCTA GTTGCTTTTCTCCCCCTGCTCCTTTCTCA GCATCTTCATGCACTGTCTCTGCAAATCC CTCATCCACCATCTACTTTGCCATCTGTT TTGTTTTGTTTTTTGTTTTTTGAGATGGA GTTTTGCTCGTCGCCCAGGCTGGAGTGC AATGGTGCGATCTTGGCTCACCGCAACC TCCGCCTCCCGGGTAAAAGCGATTCTCC TGCCTCAGTCTCCAGAGTAGCTGGGATT | 0.005648885 | 0.007042573 | 6.92E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ACAGGCATTCGCCACCATGCCTGGCTAA TTTTGTATTTTTTAGAGACAGGGTTTCTC CATGTTGGTCAGGCTGGTCTCAAAACTC CTGACCTCAGGTGATCTGCCCGCCTCAG CCTCCCAAAGTGCTGGAATTACAGGCGT GAGCCATCGCACCCAGCTGCCGTCTGTT TATGGGTCTCCTTCATTCTTCTTTCCCATT TCACCATTTTCTATTTCCTCTCCTCCAC ACATTCATAGGGAGGGGACTG | | | |
| 854 | 3869641 | 6 | | AGTTTCGCTACAGGAGGTGTCTGCACGG CCCTACTGCAGAAAAGACCGGGACGGG ACCAGCCTCAGGGCGACTTTAAACTCAA AAGGAAAAGACTCACGGACTCCCACCCG GACGTCTCAATTTGCTCTG | 0.008706715 | 0.008642584 | 1.06E-05 |
| 981 | 3870896 | 2 | CDC42EP5 | CCCCACTTCTGTATACATAAACGGCCAAG GTGTGTGCCCGG | 0.001409908 | 0.012765074 | 9.25E-06 |
| 1795 | 3871283 | 9 | PPP6R1 | TCTTGCATGCCCAAGTAGAGGGATGCGT GAGCACCATGCTGAGCTTGGGGCCACCT CCTGACAGCAGCCCTGAGACGCCCATCC AAAACCCTGTTG | 0.000982084 | 0.006611289 | 4.50E-06 |
| 1919 | 3872856 | 9 | A1BG; ZNF497 | CAGGAGCGAGCCTGCAGACCGGGCGTTG CGCCCTTCGCCTCTCCC | 0.000570716 | 0.007014539 | 5.81E-06 |
| 1967 | 3873181 | 2 | TRIB3 | GTGGGACTCTTCTGGGGACACTTGGGGT CCACAATCCCAGGTCCATACTCTAGGTTT TGG | 9.59E-05 | 0.006721722 | 2.86E-06 |
| 400 | 3876447 | 5 | JAG1 | GGCAAAAGGCGTTTTCTCCACATGCAGA AAGTCCCTTGCTCTGAGCACATACGTAC ACACATGCTCTTTCTTTGTATACATGCTG ACTACACGGGCAGGATGCAAATCCTGGC TGCAGAAAGGAGGCAGGTCAAATCAGA ACCCCATCCTTAAGCCCTCCATGTGCCCA CACCATATCTACAGAAGCTCAGGGACTG GAAAAGACAGCAAAAGGCATAAAAGTA AGGGCCTGTCAATTACATTCTGTGATTA GCATCGTGGCAATTG | 5.48E-06 | 0.017523697 | 1.48E-05 |
| 1934 | 3878250 | 6 | | CCATGTCGCTGGCAATATGTCATTGCGT AACACCAAATAACCCCCCAGAAGTAGCC AGAGGCCAGTTTGAACATCACAATTCTA AGTGTTTTAGTAACTATTTCTGGCGTGAG TCAACAGATCATGTAGATAGAGTCAATT ATTGTTTGTGGAGTTTTTCAGCTATAGGG GAGGGGAACTATTAAAATCCATTGTTT CTATTCAATAGGTAATAAAAATTAGTTG TCCCTGGGTTTGGGAAACTTAAATGCCC ATTACAGCCCTGGGGA | 0.002600581 | 0.007315515 | 4.90E-06 |
| 394 | 3879946 | 7 | NCRNA00261 | TGGACGCATGGGAAAACCACTACCCCAG CATTGTGGTGCCCTTCTGCTGAGCAAAT AGTTCAAACTGTTCATTCCCATCTTCTAT TCTCTCCCTGGTACATTGTTTGTGCCCTT GCATTTCATTCTGCAAGGAAGGTTGCTCT CTGGGCCTATAAGCAAACAGTCCAGAAA AGGGCTAGCCATCCTCTT | 0.001670221 | 0.009304477 | 7.16E-06 |
| 1786 | 3880845 | 2 | GINS1 | CCATGCGCCGAGGCACTTCCAGGCTTCA C | 0.000570716 | 0.007449206 | 4.29E-06 |
| 1322 | 3881457 | 9 | TPX2 | GGAACTGGAGGGCTTTTTCAGGGCAAAA CTCCTTTGAGAAAGGCTAATCTTCAGCA AGCTATTGTCACACCTTTGAAAC | 1.47E-05 | 0.011597387 | 5.87E-06 |
| 1223 | 3881458 | 9 | TPX2 | GACAACACTTACTACAAAGAGGCAGAA AAAGAAAATCTTGTGGAACAATCCATTC CGTCAAATGCTTGTTCTTCCCTGGAAGTT GAGGCAGCCATATCAAGAAAA | 0.003181899 | 0.011954527 | 9.58E-06 |
| 165 | 3882316 | 1 | | GTAAGGATGTTCAAACGCTGGAGCATCA CTGTG | 2.10E-06 | 0.027157072 | 2.16E-05 |
| 1904 | 3884900 | 4 | FAM83D | TGCTTCGATTGCTTTCGAGTCATGAGTTG GTG | 0.000483071 | 0.007216721 | 4.26E-06 |
| 1546 | 3886774 | 2 | SEMG1 | TATAAATGACAAGGTCGGCTCAGCTCTC A | 0.005890702 | 0.009568906 | 6.81E-06 |
| 1826 | 3887717 | 7 | SULF2 | CCACAACTGCGAGGGATTTTCTTTTACAC TGGCCACAGAGCGTTTATTGACACCACC ACTCCTGAAAATTGGGATTTCTTATTAGG | 0.006618995 | 0.007122866 | 2.39E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | TTCCCCTAAAAGTTCCCATGTTGATTACA TGTAAATAGTCACATATATACAATGAAG GCAGTTTCTTCAGAGGCAACCAGGGTTT ATAGTGCTAGGTAAATGTCATCTCTTTTG TGCTACTGACTCATTGTCAAACGTCTCTG CACTGTTTTCAGCCTCTCCACGTTGCCTC TGTCCTGCTTCTTAGTTCCTTCTTTGTGA CAAACCAAAAGAATAAGAGGATTTAGA ACAGGACTGCTTTTCCCCTATGATTTAAA AATTCCAATGACTTTCGCCCTTGGGAGA AATTTCCAAGGAAATCTCTCTCGCTCGCT CTCTCCGTTTTCCTTTGTGAGCTTCTGGG GGAGGGTTAGTGGTGACTTTTTGATACG AAAAAATGCATTTTGTGCAGCTGGTGAG GTATAATCC | | | |
| 1668 | 3889268 | 4 | RP4-723E3.1 | AATATGTGCGGGGAGCTGACTGTCCTCT GGAGTCCTCCATTGATCTCTGTTCCTTCA TCCCGTCCATGGCCTTGAAAGCACTTACT ACAATTG | 0.004322902 | 0.006987245 | 4.02E-06 |
| 1070 | 3890589 | 2 | RAE1 | TCTGCCTCATCTCTGTACGAATTTGGGTC CCAGCCTTGTTGGGTTGTCAGCCATGGA CATGGATTTCAACCCCTGGAGAAAACGA TGTCATTGTTCAGCAGCTGAGAGCCCAG GCGTCCGCGGCGACTTGCCGTCTCTCCAT TCCACTGCCTGTTGCAGAGTTTTTCTGTA ACTAAGGGGGTTGAGGTTATTGTAGACG TTAGATTGCGGGCACCGCCAGGGATTTT GCAGCGCTTCA | 0.002811439 | 0.009946063 | 9.48E-06 |
| 1059 | 3890610 | 4 | RBM38 | TTTTCCACCGTTGCTGTAGGGCTGCAGGA TCCACTGAGTGCACCTGCCTTTGTGCTGG AAGCCAGGGCTCCTCTCTGACCCTGAGG GTCCCTGGCTCTGGGAGGGAGCTCGCA GGGCTCCTCTCTGACCCTGAGGGTCCCT GGCTCTGGGGAGGGAGCTCGCAGGGCTC CTCTCTGACACTGAGGGTCCCTGGCTCTG GGGAGGGAGCACTGTGTTTTCAGTGCCC ACATGTTGCCAAACCGCGCTCCAGAAAG CTGCCCAGTTTCTGTCCCTGCCGAACGCA GGAGAATGCAGGGAAGGATGTTGTACTT TTTTCTCCAGAGCTGCTTCCCTTGAGGGGG GCCCCTGCCTACAGGTCAGAAGGAAGCT GAGGTTCCAAGTCACCCCCCAGGCGGGC CTGGCCTGTGTAACACGCAGGCGTGCAA GGCAGAGGAGATACTGATGCCCAGGGC ACAGTGCCGTGCCCTGGAAGACCACTCC GTGCCTCGGACTCTGCAGCAGCTTCTGA TGCCGCGGAGGTGGCTGTTCTGTTGCAG ACGGGAAACTGAGGCTTAGCGGCTTGCC CCAGGCCACCGAGCAGCTGGTTGGCAGA GCAGGCACACGCCAGGAGAGCTGCCTCC CTGAGCCTCATTTCCCCCTGTGCTGAGGG CTGGGCATGCTGTTGTATGGCCAGCCCA CAGCAGGCAGGAAGTGTTGGCCTCAATG CGTTTCCACAGTGGCCTGCCCAGGTAGG GTTAAGAGCACAGCTC | 0.033605237 | 0.007490625 | 3.98E-06 |
| 338 | 3891323 | 5 | CTSZ | AGGTCCCATCGTTTCCTGTGTCGCAGGTC ACTTCTTCACCAGGTGGCTGACTGCATC ATTGTGAGGCAGAGCCATGCTGTGCAAG TGTCATAAGTCATCCCACTTTCAACTCTC AGGAACACTCGCAGCCAGTGCCACGCTG TCCTCGCCATCCAATATTGATAGCCACCC CAGTTCCTGCCAGCCAGCCTGGCACACA TAACCATAGGATCCCCTCTGGTCATGGG TCACCATGCCTTTTCTTAAACTGCGCTTC TAGTGACATGGCCTTAAACGATGGGGTC CCCAAATGTACAGTGCTCCTCGATGGCA AGGTTGTA | 1.03E-06 | 0.019701911 | 1.99E-05 |
| 1717 | 3893625 | 4 | ZGPAT | GCCTCCTGAGTAGACGTTTCCCGGCCAA GG | 0.004976894 | 0.007043225 | 5.36E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 865 | 3894010 | 9 | MYT1 | GTCCAGCAAGCAGAAAGGCATCCTGAGTCACGAAGAGGAGGACG | 0.031823166 | 0.007346013 | 6.25E-06 |
| 1092 | 3895779 | 4 | RP11-119B16.2 | CGCCACCCTCCTGTGGCGAAGGAGGGGAAGTGGGAGCCGGGAAGTAGAGTTGGCCTTTTGCAGGAGAGTCTGGAGCCCCTTTCTGGGTGATGCATTGGGGGCCATAGAAGGATTTGGCTGCCGCTTTGGAGCATGGAT | 0.000152935 | 0.007248562 | 4.58E-06 |
| 1277 | 3896023 | 2 | PRNT | AGAGACAGCCTGGAAAGATTGGGTGCCAGCTGCAGAGAGGAGAGCAAGGCGACCAAACGCAGG | 0.018126 | 0.007004643 | 4.38E-06 |
| 1078 | 3896401 | 4 | GPCPD1 | TTAGAAGGGCTGTCCTGCATGGGCTCAGTATGGCTACTAACAGTTATTCTCATTGTTGAGTAAATAGAGTTGCTAGGCCTGTCTAGTGTAAGCATTCA | 0.000192114 | 0.009048337 | 5.25E-06 |
| 1963 | 3899419 | 4 | OVOL2 | ATGGTGTCTTTGTTTGGAGCCCAAAGGGAAGGATTGACTAGATTGGGAAAAATGCAGATTGGGAGATGTTTGGAGTGGGCCAGATGGAGAAGAAAGAGTCAAGTCACCTCCACCCCTAGTGGCCTGAATGCTGTCATGCGGAATTGCCTGGTCCAGTTAACAAACCCTCGCTTCATTGTTTTATT | 0.003024609 | 0.006721937 | 3.45E-06 |
| 1563 | 3899905 | 5 | RIN2 | CATCATTCTAAGGTGCGGTCCAGGAAGCTGTTTTTTGTTTGTTTGTTTGTTTGTTTTGGAGCCCTTCAGTGATTCATACAAACAAGCCAAGGAGAGAACACATGGACGACAGCATTGATTCACTGGAAAGCAAAGTACAGCTTCCACCATAAAACCCTGCAGCTGAAAAAGGACAAACTGAGCAGCTCTCAAATAAAGACAGCCTCAGCCGTCTTGCACAGCACGGCCCCTCTCCGTGCCCGAGTCCTGTGCCTGTATGAAAGCACTAAATCACAGACCCCGCAACCTGTTATAAGCCCTGGTAACAATCAGCAGCTG | 8.88E-05 | 0.008535517 | 1.66E-06 |
| 305 | 3901183 | 5 | GZF1 | TCCTGATTCTGGAGTGCAGACTGCCTAGATGGCACTCCTTCCAAGCCTGAGAACCAAAAGACCAGAGACGAGTCCTAAAGCCTGAAATGGCATCTCACTGAGGTCTCTACTGAGACTGTGGGACCCGG | 0.006537209 | 0.011649055 | 8.10E-06 |
| 1588 | 3901363 | 2 | CST1 | GTGCCAGGCCATTCGCACCAGCCACCACCCACTCCCACCCCCTGTAGTGCTCCCACCCCTGGACTGGTGGCCCCACCCTGCGGGAGGCCTCCCCATGTGCCTGCGCCAAGAGACAGACAGAGAAGGCTGCAGGAGTCCTTTGTTGCTCAGCAGGGCGCTCTGCCCTCCCTCCTTCCTTCTTGCTTCTAATAGCCCTGGTACATGGTACACAC | 0.000435853 | 0.006853365 | 3.36E-06 |
| 2028 | 3902753 | 7 | ASXL1 | AGCCTCATGGACCAGATCAGTGTCAAACTGTACCCTTGAGTGTCCCCAAAGGTTCCAGCAGAGGGAAGAAGAGGACTGGACATGTTTGGGCCCCTGTTCCCGGTCTTTGGTAAACAGACGCTTAAGTTGACAACTTGGACTTGGCCAATA | 2.67E-05 | 0.006638061 | 3.60E-06 |
| 2030 | 3903852 | 3 | EDEM2; MT1P3 | AAGGAGGCATCATCAGGCTGTGTTCCTGGAACCCCAATAACCCTGGGCCCCCAGGGCCAGCCTGTTGTAGAGGGAGGCTATCTGACCGCCGGTCTGGCAGAGGAGATGGGTGGGCAGCTCCCAGACACCCCAAAGGACCCGGTTCTCTTCCCAGAGCGTCCTAAGGTTACTCTTGGAACCTGATCTTTGTTCCCTCATCCCAGGGAAATGACACACTCTGTATTTCTGTTTTATTTAGAAATGATTTAAAAAACATTATACAAAGGCTGATCAGTTTAAAATGTGACTGACACTGAAATGCTGTGATGTCCCCCAGGCTGAGGGGAAGCTAGGCTCTGGGGCCCCCAGTGCTTTGCCCCTCTGTCTGCCCTGTCCTGGGGTGATGGACAAACAGATGACCACAGGCAGGAGAATCTGAGATTGGAAGCCTCTAGGCTGAGCCCTCTGGGCCTGGCCCCACATCCCTCACCTCTGCAGCCTGGGCTGCCTGCCTCCATCTCCTGTTCATT | 0.000532413 | 0.007106081 | 6.51E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | CTCAGCTGGCCTGCCAGGAGCCAATGGG GAGCCTGGCGGGAGGCGGGGGTGCCTA GAGCTTTCAAGAAGTGAGAGCACCAACC TGAGGAGTGGACAGGGACCAGGAAGTG GGGGAAGGGAGGCCAGGAAGAGGTGGA TACAGGAGACACTTCTCATCTCATCTCA GACCCTAGAGGGGTCCACAGATGGGGAC ACAAGACCCAGCCAGCCCACTGGATGGC CCGGGCAAGTAACAACCTCTCTGTGCTT CATCTGAGGGCACGGTGAGAGTTACCGT CGGCCTCCCAGGGCCTAACACGAGTTTC ATG | | | |
| 1731 | 3904090 | 9 | FER1L4; AL389875.1 | CCCGAATGGAACGAGCAGCTGAGCTTCG TGGAGCTCTTCCCGCCGCTGACGCGCAG CCTCCGCCTGCAGCTGCGGGACGACGCA CCCCTGGTCGACGCGGCACTCGCTACGC ACGTGCCGGACCTGAGGCGGATCTCCCA TCCGGGCCG | 5.05E-05 | 0.007249279 | 5.01E-06 |
| 871 | 3904560 | 2 | NDRG3 | TCTTGAGATTCCTCTACTCTCGTTATCTG ACC | 0.017888918 | 0.009731465 | 6.23E-06 |
| 901 | 3907235 | 2 | SDC4 | TCCAGCTCTGATTACCTTGAAGTGTTCA GAAGAGACATTGTCTTCTACTGTTCTGCC AGGTTCTTCTTGAGCTTTGGGCCTCAGTT GCCCTGGCAGAAAAATGGATTCAACTTG GCCTTTCTGAAGGCAAGACTGGGATTGG ATCACTTCTTAAACTTCCAGTTAAGAATC TAGGTCCGCCCTCAAGCCCATACTGACC ATGCCTCATCCAGAGCTCCTCTGAAGCC AGGGGGCTAACGGATGTTGTGTGGAGTC CTGGCTGGAGGTCCTCCCCCAGTGGCCT TCCTCCCTTCCTTTCACAGCCGGTCTCTC TGCCAGGAAATGGGGAAGGAACTAGA ACCACCTGCACCTTGAGATGTTTCTGTAA ATGGGTACTTGTGATCACACTACGGGAA TCTCTGTGGTATATACCTGGGGCCATTCT AGGCTCTTTCAAGTGACTTTTGGAAATC AACCTTTTTATTTGGGGGGGAGGATGG GGAAAAGAGCTGAGAGTTTATGCTGAAA TGGATTTATAGAATATTTGTAAATCTATT TTTAGTGTTTGTTCGTTTTTTTAACTGTTC ATTCCTTTGTGCAGAGTGTATATCTCTGC CTGGGCAAGAGTGTGGAGGTGCCGAGGT GTCTTCATTCTCTC | 9.59E-05 | 0.014513443 | 9.93E-06 |
| 232 | 3908635 | 2 | PREX1 | CATCTTAGCTTCCAGGTTCACCCTAACCC TGTACTAACCTGCTTGGTGGACTTGGAA AAGACTTGGCTCTGTCGGGAAAGGAGAG ACGGGGCCTCCATCACGCCTGTTACCAG AGGATCCCCGAGAGCCACACCAGCTCTG GACATCACCGCCCCTGGAACTGGGGCCA CCAGCCCTGGGCACGAGATTTGCTCTGA CTTTATTTATATGGCATGAAATCTCTGGT TTATTTTGGGATTTTTTGTTGTTGGTGTT GTCAAAGTTTGTTTTTTCTAAAGTTGTGT GATTATATATTTGACATTTTACATTTCAA AGAAAGGTATGTTGTCTAACAGGGGACC AACAGAAGGTAGTATT | 0.000518037 | 0.014616305 | 1.08E-05 |
| 1083 | 3910198 | 5 | TSHZ2 | GGGTCTTGCAGCCAGGACAATCCTGTTT GGAAACCCGTATGAACTCTCTCACATTC ATCATTCACTTCCTGGAGAGACAGATTTT GTAAACTTTACAGAGCAGCTTTTAATCA TTCGGTGGTTCCCAGATTCCTAGGCCAG AGTCTCTATACTGAATAATTTATAATAG AGGTCATATCCATCATGGTGGCTTGAAT TCTGTCCTCCCAAGAACACAGGCTCAAG TCCTGACCCCTCCTACCTGTGAATGGGA CCTTATTTGGAAATGGAGTCTTTGCAGGT GTAATTCAGTTAAGATGAGGTAGGCCCG AAAAGCAATGACTGA | 0.000637737 | 0.007642783 | 4.14E-06 |
| 2005 | 3910788 | 2 | AURKA | GCCAGGGCTGCCATATAACCTGACAGGA ACATGCTACTGAAGTTTATTTTACCATTG | 0.002303775 | 0.008034016 | 6.32E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1776 | 3911737 | 5 | GNAS | ACTGCTGCCCTCAATCTAGAACGCTACACAAGA CCAGAAACTCATCTCGAATGAAGTACTT GGCCCGGGTCACGCGTGGGTCCTCTCCG GGCT | 1.65E-05 | 0.006751443 | 4.63E-06 |
| 655 | 3911768 | 2 | CTSZ | GCCATGTCACTAGAAGCGCAGTTTAAGA AAAGGCATGGTGACCCATGACCAGAGG GGATCCTATGGTTATGTGTGCCAGGCTG GCTGGCAGGAACTGGGGTGGCTATCAAT ATTGGATGGCGAGGACAGCGTGGCACTG GCTGCGAGTGTTCCTGAGAGTTGAAAGT GGGATGACTTATGACACTTGCACAGCAT GGCTCTGCCTCACAATGATGCAGTCAGC CACCTGGTGAAGAAGTGACCTGCGACAC AGGAAACGATGGGACCTCAGTCTTCTTC AGCAGAGGACTTGATATTTTGTATTTGG CAACTGTGGGCAATAATATGGCATTTAA GAGGTGAAAGAGTTCAGACTTATCACCA TTCTTATGTCACTTTAGAATCAAGGGTGG GGGAGGGAGGGAGGGAGTTGGCAGTTT CAAATCGCCCAAGTGATG | 0.000126082 | 0.017035647 | 1.84E-05 |
| 715 | 3911769 | 9 | CTSZ | GCTGAGGATCGTGACCAGCACCTATAAG GATGGGAAGGGCGCCAGATACAACCTTG CCATCGAGGAGCACT | 8.58E-06 | 0.016324218 | 1.44E-05 |
| 769 | 3912527 | 5 | CDH4 | TGTAAAGTGGGGCACCTGCCGTGCTCTG ATCACGTGGCCCACGGAGCTGGGTCCTG CAGTCACTCCCTGCCATGGCGC | 0.004061321 | 0.009439512 | 1.15E-05 |
| 892 | 3913561 | 4 | DIDO1 | CTTCTGCCCATAGCGGGGTACTCTGACCT CTTCTCCCTCTTCCCTTCTTTGCCACACA TCAGCTCCTCTGGGAAGCTGATTTGCTCC AGGGACAGGAGGTGGGGGAAATTGCCT GTTAACCTTCCCAACACATCACCTCAAG TTAAAATTGGTGGATTTCCAGAATTTGTA TAGGATGGGAATGGGGACGACACACTTT TGAGCTAGTAGCTTCTGCTCGTTTTGTTA TCCCGTAAATGTTGTCTTCCCAAAAGGT GATTGATTG | 0.001283816 | 0.008853705 | 3.51E-06 |
| 962 | 3913575 | 9 | DIDO1 | AAGGCGGCTCAGGACATCAAAGATGAG GAGCCTGGAGACTTGGGCCGACCGAAGC CTGAATGTGAGGGTTACGACCCCAACGC CCTGTATTGCATTTGCCGC | 2.25E-05 | 0.010752142 | 1.01E-05 |
| 1542 | 3913577 | 4 | DIDO1 | CCCTGCTGCGCGTGTTTGGCGGCAATGT CACCTTTTGTTCTGTGGTCAGTTGGTCAC TATGTGCTTACACTTTACCGCTAG | 0.002951948 | 0.00662747 | 1.65E-06 |
| 1804 | 3913713 | 2 | YTHDF1 | GGACCGTTGAGCTCACTACCACCTGGAG TTTGAGTTGAAGCATGAAAATGGTGCCC ATGCCTGACGCTCCAGCGCCTGGATCTG CACGTGCCCTTGTAGAGGATCCTTACCG TCCTAGAGAGCAGACGCTTTCTGAAAAC TACTTGCTCCAAAAGACCCTCTGAGTTA ACGTTTCAGCTGTATCATTAGACTTGTAT TTAGAGCGTGTCACTTCCTCTGAACTGTT A | 0.000722593 | 0.007517051 | 5.77E-06 |
| 1875 | 3917818 | 8 | TIAM1 | GACCACTGCCCAATCACCCATGTCACGG GCTTGGCAGCCAGGCTCAGGTGGAAGCT TCCTGCATCCGTCCTCTCCAC | 0.000272577 | 0.006979198 | 6.08E-06 |
| 1220 | 3918161 | 4 | C21orf63 | TGAAACAGCCAAGGACCTGCGCTTATT GATCAAAATCTA | 0.04726916 | 0.008466627 | 6.54E-06 |
| 1638 | 3918604 | 2 | IFNAR1 | CAGGCTGGCTTCTCGTCTAGCAGTATTCA GATACCCCTTCTGCTCAGCCTGCTTGGCG TTAAAATACAAATCATTGAACTGAGGGG GAAAAATGTAACTAGGAAGAAAAACCC AATTTAAGAAATTACATAATGCTTTCCA AAGGCACCTACAACTTAGTTTTAAATTA CTTGCTACTGGGATTACCCATGGATAT CCTTAATAGGCAGGAAGTCTGGGAATTC TGGTGGCCTCTAGGGCAGTGTTCTCACA GCACCGTTCCGACAGG | 0.000200907 | 0.007891488 | 3.40E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 453 | 3919218 | 7 | RCAN1 | CCACATTGCATTGCTGCTGTTTTCACAAC CTCTCTGCACTAGGCGGCTTCCTGTGGTA CCTCTTCCTACCAGTAGAGAGTGGCCC | 0.001643447 | 0.006886772 | 3.36E-06 |
| 1437 | 3920026 | 9 | CHAF1B | GTGGCCTCGGAGGATTCCGTGCTTCTGT ATGACACCCAG | 0.000197761 | 0.007853932 | 4.30E-06 |
| 1044 | 3921056 | 1 | | GAAGCTCGGTCCACCTCTGAAGCTGGAG CTGCTGTCAGTCAATGCTCAGAACCTCTT GGCAAA | 0.003428273 | 0.009262185 | 5.83E-06 |
| 206 | 3922319 | 1 | | TCTGTCAGCCGACTTCGGGGGAGCTGTG TTCAGGAGAGAAGGGCTTGGGAAAGCTG TGCTCTATTCCATGCTGGATAAAAGGAG CAGAGATAACCCG | 0.044564191 | 0.014070978 | 1.58E-05 |
| 1659 | 3923366 | 4 | AGPAT3 | CACAGATTCTGACAGGGTCCAGCTAGGA AGGTAAGTGAGAATGCAGACATGAGGC CTATGAAGGGGTGGCTGTGGTGAACATG AGTGAGAGACTGAGGCCTCTTTCACAGG GTCTGGCTCACCTGACCACCCGCTACTG ACCCCCAGCTGAGCAGGGCCAGGTGGGT ATAGGACCAGAGTGACTCCATCTTTAGT CTTCCG | 0.000462937 | 0.006632473 | 3.14E-06 |
| 1766 | 3923935 | 7 | SUMO3 | AATAATGTACAAATTGGTGAATAAACAC AACAGAGCCAACAAACATCCCACCCGAG CCCATACAGCAAACAGGAAATGAGAAC ATTTCAGCAAGATTTCAAGCAAGCAAGA GATGATGGGTCATTGTTCAGGTGACT | 0.000873066 | 0.009282175 | 6.64E-06 |
| 1396 | 3925911 | 8 | C21orf34 | GGGTCCTTACATCATTCATCACATTAAAC TGTAACATACTGTCAGAATTCACTGGGC ATTAGAGTAGCTGTCTGGCTTTTGTGTAG ACAAAATACTTTCTCAACTCCACCGCTTG GGCAAAGGCAAGGCTGTGCTGACCCAAT TTCCATTCC | 0.044263782 | 0.007994666 | 5.95E-06 |
| 1772 | 3927606 | 1 | | TGATCAGAAACATTGGGGACTTGGCACT TATCATGAAA | 0.002641545 | 0.006502541 | 3.15E-06 |
| 2073 | 3929666 | 2 | TMEM50B; AP000300.3 | GCCAGCACCGACAGCAACGAAAATGTTC CCACGGAGATCAGGATGACTTGCTGAAG CTCAGTGGAGGCTAAAAAGAGGACACG AAAGTGAACAGAATGATCTTCCTACGCA CAACACAAACATCAGTTAATGTTCCATC CATGCTGCTTAAAGAGCATTCCTGTCCTA GTAAAATGGGCAAGTCCCTCTACCCCC ACCCTCACCTGGTATGCTTACATTA | 0.000525832 | 0.007247528 | 2.97E-06 |
| 2006 | 3930023 | 5 | MRPS6; AP000318.2 | TGCACATCCCACTAGTCAAAAGGAGAGA TGCAGAGTAAAAGAACTAGAAATAAGA CAAAAGACAGAAACAACATCTAAGGCA CAGGCAGAAACACTTAACAGTGCATCCA AACTTCTAAAAATTCTTGGGATTAAAAT ACAAAACCAAATGGATGTTCAACTCCTG AAGCATATGGGGAACAATACAGCAACA AAAAAAAAAAAAAAACCTCAACTCTGAA AAGCCATGGAAAGCTGGAAAGAGAGTC AGAAACTCCTATGAAGAGACAACAGGA CTTTTACAGGGGGCCTACCTTAGGGTATG CCAGTGAGATCCCAAATTA | 0.000153753 | 0.007677257 | 6.18E-06 |
| 1207 | 3932278 | 3 | HMGN1 | GGGAATACGGTCGACGAGACTCCTCCGG TATTCAACTTCATGACATTGTCCTGTCAT GTGGAACTGTAGGGAATAGTGGATGATG GCGACAGTGGTGAAATATAGCTCGGGCT TTAGGATTTGTCATATGTCTAATGAGGCT TGACATGCAAGTACTATTAAAATCTCCTT AGCATACATTGTTTTCCTGATTACTGGGG GGGACCTTAAGTTGTCTCATGTAA | 0.00195225 | 0.009766647 | 7.74E-06 |
| 1398 | 3932707 | 4 | DSCAM | TCTACAACTTTAGGGGACACAAGGCAGT TCATAGCAGTTGCTCTCCTTTGGTTTGTA TCCAACTACACTGCCTGGTTGATCTTCTC TCTGAATATTTCGGTGCTATCTCTTTCCT TCAGTTTGCATCTTCCCCTCTCAGAAATG TATGTCAATCTAAAAGTCCAATCCCATC CACTTTCTGTATTGGTCATTTCATCATCT TCCAGGGCTTCATCCATGACTTGCACCTG TGTGACC | 0.014179003 | 0.007108958 | 2.59E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1673 | 3934672 | 9 | SUMO3 | GCCGTCCATCCTCGCATTGCTGTTGAATGGTGAGCACGTGACCATGCCGACCACAAAGGTGTCTGCGGAAACTCGAGGACATTCACCACGATGATTTTCCTCTCTTTGATGTACTTCAAGTGCAACTCAAAACTATATCTGCAGGGATGAATCTGTAACTTAAATTGGGCCAATCAGAATTGTTATCTTTGTTCAGGTAAAATGAGTTGCAAGATATTGTGGGTACTTTTGTGTGCTCATTTGTGTTTTCCCCCCCTCCTACAACATTTTTTTAACCCCAAAATTATAGCCTGAATGTTCGCTTTTAGTCTGGCCAGGGATCTGACTCCTGAGTTGGTTGCCTCTCCCCTGCTCACTCCAGTCACATAGAGAATTGGTGTTTCCCGCAGTGGGGATGCAGCTGTTGGACAGGTATTGGGGGCAAGGTTGGTAGGGAGGACAGACTGTCACTTGCTGTTACAGGCACAGGTGATTAAAATGCTAAATATTGCAAATTTAAGCTTTGTCAGTATATGGAAAAGTTGAAGGGAAAATACTGGAATGCTTCTTCAAAGGTTAAAAAATAACCGAGTCTTTTGGTAATTTGACCCCACGTGCTCTCTGGCCCTCAAGCATGTAACCTCG | 0.007946892 | 0.009316771 | 7.21E-06 |
| 1298 | 3936105 | 7 | CECR1 | CAGGGCGAGCACAGGAAAACCTTCTCTGAGACAGTGACATGAACTTGAAACTTGAAGGGTAAACAGGAGTGGGCAAGACAAAAGGGGAAAGAAGGAATCTTCCAGGCAGAGAGAAAGAGAAAAGACCCAGGCACGGTATAGAGCCGAGGACATTTGAGGAAGAAAGGGCCGCCGGGGTTGGGGCCCTCTGGGTGACTGGGAGAGGAAGGCGCCGGAATGGATCCAGATTAAATCGGATGCTGTATGCCCTGTGGAGACATGGGGTGTACCTCTAAACGCACTGC | 0.002629781 | 0.007226038 | 4.30E-06 |
| 670 | 3936779 | 3 | DGCR5 | GGCCTCTCACTTGTGGGACTCCCGAGATGCAGTGGCCAACACGAGTGTAGTGCCCAGTTCACTGCTGGATAAGACAGAGGCCTGTTCTGGTCACACATGGGAGGCAGAACCCAGAGACTGGGCCCAGGAGCCCTTCTGCTGACAGTGGGAACTCCCAGCTACGTGTGGGGGTCCCCATACCAGACAAAGGTCCCTGACCTTAGTCTTGCCCGAGAGGCCGACACAGCCCAGCTTTGGGGTCTGGCTTTACCCACAAGAGGCCACACCTTGCCACAGCACTGTTTATCTGGCCTGTTTCA | 0.006297356 | 0.007821734 | 5.43E-06 |
| 882 | 3937768 | 9 | SNAP29 | ACACCTTCGAGCCTATCACCAGAAGATCGACAGCAACCTAG | 0.000509079 | 0.008037211 | 5.22E-06 |
| 1735 | 3937798 | 2 | CRKL | CCCTAGTAACTGCTGTCGGTGTGGACGCTGTGCTGGTTCTGTTTTCTAAAGGAGCAGAAGGACAGGTCTCTGAGACAGGATCGTTGTCCCTACAGGAGGAACAGTGGCCTTGCTTCTTAGACGGTC | 0.000113778 | 0.011359599 | 1.07E-05 |
| 653 | 3939344 | 1 | | GGCACGCTGGGGATTCCTGCCAGAATTCTGGAAGCTTGGGCCCCATCAAGGCGGTCTCTTGCCCCTGA | 0.012377537 | 0.006710491 | 7.82E-06 |
| 1725 | 3939351 | 1 | | CAGCAAGGAACGGAAAGTTCACATTGTAAATATGTAGCAGAGTCTGTAATGGCTCAGTCAACGCAAAATGTTGACTACAGTCAATTACAGGAGATAATATACCCTGAATCATCAAAATTGGGGAAGGAGGTCCAGAATCATTGGGCCATCAGAGCCTAAACCACGATC | 0.002481187 | 0.007874982 | 3.76E-06 |
| 1175 | 3939354 | 1 | | ATGGGCCATAGTGACGATGGTGGTTTTGTCAAAAGAAAAGGGGGGATATGTAAGGAAAAGAGAGATCAGACTTTCACTGTGTCTATGTAGAAAAGGAACATAAGAAACTCCATTTTGATCTGTACTAAGAAAAATTGTTTTGCCTTGAGATGCTGTTAATCTGTAACTTTAGCCCCAACCCTGTGCTCACGGAAACATGTGCTGTAAGGTTTAAGGGATC | 0.0264846 | 0.007324555 | 6.75E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 707 | 3939358 | 1 | | CCTTTGAGGGAGATCAAGTCTAAATTTGAAGGGAGTCCAAATTCATACTGGGGTAATTTATTCAGATTATAAAGGGGGAATTCAGTTAGTGATCAGCTCCACTGTTCCCCGGAGTGCCAATCCAGGTGATAGAATTGCTCAATTACTGCTTTTGCCTTATGTTAAAATTGGGGAAAACAAAAAGGAAAGAACAGGAGGGTTTGGAAGTACCAACCCTGCAGGAAAAGCTGCTTATTGGGCTAATCAGGTCTCAGAGGATAGACCCGTGTGTACAGTCACTATTCAGGGAAAGAGTTTGAAGGATTAGTGGATACCCAGGCTGATGTTTCTGTCATCGGCATAGGTACTGCCTCAG | 0.00040614 | 0.010891317 | 8.74E-06 |
| 576 | 3939495 | 2 | MMP11 | GCCTTCTGGCTGACAATCCTGGAAATCTGTTCTCCAGAATCCAGGCCAAAAGTTCACAGTCAAATGGGGAGGGGTATTCTTCATGCAGGAGACCCCAGGCCCTGGAGGCTGCAACATACCTCAATCCTGTCCCAGGCCGGATCCTCCTGAAGCCCTTTTCGCAGCACTG | 0.001268815 | 0.014070716 | 9.94E-06 |
| 726 | 3940746 | 4 | ADRBK2 | GATCCAGATTGAAACCCACCAGCTATACAAAAGACACTTGAGTCATGGAAATGTGGTTAGAGACTGGGCATTGGATCTTCAGGAATTATCAATTTGAAGGGGGAGTTGGGAAGTGATAATAGACTGTGTTTATATGAGAAAATTATCCATAATTTTTAGAAATGCAAACTGAAATAGGCTAAAACGACATGTGGTCTG | 0.003965967 | 0.011477167 | 1.06E-05 |
| 1069 | 3942014 | 9 | RFPL1 | CACTTGTTTTTTGCTCCTCCAAGTCCACCTAATGGTGATAAGAGTGTCTTGAGTATCTGTCCTG | 4.10E-05 | 0.006778254 | 3.28E-06 |
| 233 | 3942071 | 9 | NF2 | AAGGACCTCTTTGATTTGGTGTGCCGGACTCTGGGGCTCCGAGAAACCTGGTTCTTTGGACTGCAGTACACAATCAAGGACA | 1.05E-06 | 0.019752284 | 1.31E-05 |
| 1946 | 3942670 | 3 | MTMR3; TUG1 | GCTGATGTACCTGACTGGCTCTGTAAGATCAGAAAACTGTATCCAGAATAAGCTACTATGGATTAACCCCTGAGTACCCAGAGTAAAACTAATTTACAGAACTTCCTTATTGATCTGCTGGTTCTTCCAGATCATATTCTGGCTATTGGTATGGCTGGCCTTTCTGAAGGTACCCTGCTTGTCTATTTTCCTGACTCAGCTCTTGCCTGCCTTTTTCACATGTTGCTGCAATTAGACTCACCGTGAGGACTACAGTCAATTTCAGTCTATCTTGTGCCCAATACAACAAGGATTTTAATAGTAACAACCCACACCTCACCCACTAGGACTCAATGTTCACAACAGGAAGGACCATTGCTGCATACTCCTTGACCAGCAACTTTTTTGAAGATATTTTTAAGTGCAGAGTAGGCCTCTATTCCTGTATGTAATTGTTCATTTTCAGCACCTGGAACCTCATCTATCGGGTCTGGAAGGAATACAGCAGTTCGAAAGCCGCGTCCATTTCTCTCCTTCAGTAGTGCAGAAATGAGTCCGATTCACCAGTACACACAGAACTGTACCAGTTCAACCTAGCAAAAGAAGAAAAGTTTCCACTGTACTTAAAATTTACAGCTGACTCAAATTGCCTCACAGAATTATTTGATGTAGAAGGCTAGTTGTCTTACTTCAGATCAGCAGGACAGTTGGGCTCTCAGACTCATGACCACTGAGTTTGCTTGTGTTGAAACTGTGGTTTCATCCAACATATGCTATTGGACATGATTATTATTCCATTCAAATGGATTACAGACTTCTTGAGGACAGGACAAACTTATCTCTCATGGTGTTTTTTTAGAATACTTTTATAACCAAGGAAGAAACCATGCCAGCTGTTACCATTCAACTTCTTAAGCAGAGATTAAGCTTTTTCATATCTGTTCTTATCCTGGACATCAGTAGTTTTTAATTGCCCAGCATCCGTTCCATCTTGTAA | 0.000153344 | 0.009669208 | 9.02E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 930 | 3943191 | 1 | | TAGGAGAGTCCATCACAGGGCAATCTGA CCTAGTCATGAAGGTCAGCAAAGGCTCT CCAAGTGACCATAGAACTGAGAACTACA GGGTAAGCAGGATTAAGTAGAAGAATTG GGGAGGAAAAAATGTTCAGGAAGAGAG GGAAGGGCACGCACAGGGCAAGATAAA GTTGGGAAGTAGGCCTGACCATGCAGTG CTCTTGGGCATGCTGAAGATTTTGATTTT GATTCTTAGAGGTTCTAAGCAAGGAGCA GGTGACAGGATCAGATTTGTATTTTAA GAGATTATTTTGGCTGTGGTTACAGAAG ATGGAAGCGGGGATGGGATGAGCAAG TGTGAAAGCCGGAGGCCTGTGGGAAGCC AATGTAGATGTCCAGGAAATTCATGATG GAACCTTGGACTGGGGAGGTGATGGGGG GAGGGGAGGAGTGGATGGACTTGAGGG CCATTTAGGAGATAAAATGGACATGATT GGGCCATGGGTTTTGTGGGAAGGATAAG GGTGAGGGAGTTATCTAGGATGACACCC AGGTTTCTGGATAAAACTGTTGCCAGGC AACAGAGAGAAAGCCAGAAGGGAGTGG GGAAGGGGTGGGACACATTTTCCCTTGC AGTTGTTTTTATGCCCATGTTTGCAAAAT AAAGGGTGTTGGAGGTGTGGGCGTGCAC AGCTCCCTGACTGCCCACCCAAGGATAA GAAGACTGGTTTAAGAAGATTGCATGTT GCAGGGTAAAGGGAGCTAGGTCTTCTAC TCTGGGCTCTGCATGCAGGTAACTGTGT GATTTCACTCCCCTGGCCCAGGACTCTG AAACAGACATCCCTCCTTGTCTGGCAAT TTCATGGCAAAAAGCAGCCTGAGTCGTA TTTGTCCACTCATGCTATTTACAGGACTC CTCCTTGGGAAGTTATTCTTGTAGATCC ACTTTATCCAGAGCCTGAAGGTGAAAAA TCATCAAGTCTAGAATGTGAGATCTGAA AGGAATCACAGAGCCCATTTTCCCAATC TTCTAATTTTACACTGGGGCAGCCCCCGT GTCTGACCCATGTCTCTATGCTACTCTAC TACCTTGCCTACAGGAAGAGAGGTTAAG GAGTTTGTCCAAAGCCACAAAGCTATTG GGCATAAGGAGGTGACCCCACATTCCTT TTCTTACTTTGGGGGTGGGGATTCTTCTG CAGCCTGCAGTTATTTCCTAGGACAGTG GGGCTAGGTAGAGCTGTGGCGATGAGCT AAGATCATAGACACAGGTGATGCTGAGC ATCTGGGGGAATAATTCATCTGAAGCTG TGCCCTGCTGAGTTGGAGTCCTTTCTGAC TCTTTAAAGATGCCTCTTGTCATGCACCC AGTCGTGACTCCTGAATATCCTCCTGGG GTTGC | 0.000468776 | 0.010341943 | 7.19E-06 |
| 1451 | 3943222 | 2 | YWHAH | TTTAACGTGAGGTTTCAGTAGCTCCTTGG TTTTGCCTCTTTAAATTATGACGTGCACA AACCTTCTTTTCAATGCAATGCATCTGAA AGTTTTGATACTTGTAACTTTTTTTTTTT TTGGTTGCAATTGTTTAAGAATCATGGAT TTATTTTTTGTAACTCTTTGGCTATTGTCC TTGTGTATCCTGACAGCGCCATGTGTG | 0.00021566 | 0.013533518 | 1.67E-05 |
| 1252 | 3943311 | 3 | RP1-90G24.10 | TGGTCACGGCTGAACAATTTCAAGAAGC GAGTCGATGTCTCATCTCCCTATCTTATC TTGAAAAACCCGTGTACCTAAGTCGTGG ATGTGTCTGCTGCATCCGCTGCATCAGTT CACTTCTGAAGGAACCCCATGAGGAAGG TGTAATGTGCTCCTTTCGCTCTGTGGCTA CTCAGAAGAATGACATCAGGCCCGATTT CCAGCTGGGA | 8.73E-05 | 0.007568258 | 3.79E-06 |
| 1851 | 3944661 | 2 | KCTD17 | CCTCCTGTGTTTGACTTCCCGGGATGGGT CCTTGCTTCTCAGCTGTGTCCGACCCCAC CATGTAATAA | 0.023538302 | 0.007190772 | 5.18E-06 |
| 359 | 3944775 | 1 | | ACAGTTCTTGCCACAGGAAGACTCGATA AAAACAGATTATT | 0.000800301 | 0.009903548 | 4.44E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 966 | 3944939 | 9 | NOL12; TRIOBP | GTGCATCGGGCACCGGGATGCACCCCGA GCCTCCTCCCCACCCCGCCACCCACCCA GTGACCTAGCGTTCCTGGCACCCTCACCT TCACCGGGCAGCTCTGGGGGCTCCCGGG GCTCAGCGCCTCCCGGGGAGACCAGGCA CAACTTGGAGCGGGAGGAGTACACTGTG CTGGCCGACCTGCC | 0.002849134 | 0.008944874 | 4.95E-06 |
| 601 | 3945520 | 2 | APOBEC3A | CAGCAGCTTCCAGGTTGCTCTGATGATA TATTAA | 8.40E-07 | 0.014765996 | 1.11E-05 |
| 356 | 3947246 | 9 | SEPT3 | CAGGAGAGCATGCCTTTTGCTGTGGTGG GAAGTGACAAGGAGTACCAAGTGAATG GCAAGAGGGTCCTCGGCCGAAAAACTCC ATGGGGGATCATC | 0.004699102 | 0.013660068 | 1.15E-05 |
| 1428 | 3947350 | 6 | | AGGGCTTCTTCCAGACGGCCTCATCCTTC AGCACCGATGACAGGTTGGTGATGAGTG TCGTTCCCTGGGCAGGAGATGCAGGGTG AGAGTGGGGACTGGACTCTAGGATGCTG GGACCCCTGCCACCAAACACACGGGGGA CACACACTGCCTGGCACACAGCTGGACT CTGTCAACTAGTCCTGCGCCCGAGAA | 0.000372622 | 0.006796499 | 3.83E-06 |
| 380 | 3948681 | 9 | FBLN1 | AAGGGACATCGCTGCGTGAACTCTCCCG GCAGTTTCCGCTGCGAATGCAAGACGGG TTACTATTTTGACGGCATCA | 0.006969913 | 0.009183224 | 6.72E-06 |
| 101 | 3949198 | 9 | GRAMD4 | ATACAGTGGAGCATCGTGCCCGAAGTGT C | 3.80E-05 | 0.021704647 | 1.73E-05 |
| 1075 | 3949566 | 1 | | ATGGCACGCACCCAAGTGCTGGGCATTG TGAGAGCTTTCTCTGTGCCGGGCTCTGCT TGTGAACAAGAGCCCTCTGAGACAGTGA TGGGAACCATCTGCATCACAGAAGCACA AGCTCTGGTGATGATG | 0.000248937 | 0.007112984 | 2.14E-06 |
| 1751 | 3951205 | 6 | | GGGGTGAACATGAGTACCACAGTTAGAC TGAGGTTGGGAAAGATTTTCCAGACAAT TGGAAGAGCATGTGAAAGACACAGATTT TGAGAAATGTTAAGTCTAGGGAACTGCA AGGCTTTTGGCACAAGAAAGCCACTGTA GACTATAGAGGCAGGATGCCTAGATTCA AATCCCAACTGCTACACTTCTAAGCTTTG TAATTTTGGCAAGTTTTTACCCTCTATTT TCTTATCTATAAAATATAGATTTTATATA TATAGATATAGATATATAGATAGATAAT AATTGTGCATGCCTAATAAAGTTGTCAA AGATTAAATGTTATATGTGAAGTATTTG TACGGTGATAGGAACCCAGGA | 0.000130223 | 0.007570276 | 4.56E-06 |
| 1603 | 3952519 | 9 | DGCR14 | TGATCCCCCAGGAGTCCCCTCGAGTGGG TGGATTTGGATTTGTTGCCACTCCTTCCC | 0.015281883 | 0.008978517 | 1.28E-05 |
| 1899 | 3953861 | 7 | CRKL | CGTCTAAGAAGCAAGGCCACTGTTCCTC CTGTAGGGACAACGATCCTGTCTCAGAG ACCTGTCCTTCTGCTCCTTTAGAAAACAG AACCAGCACAGCGTCCACACCGACAGCA GTTACTAGG | 0.001504933 | 0.007170792 | 4.34E-06 |
| 1237 | 3954368 | 2 | TOP3B | CTGCGGAAGAGTGGAGTCTAAACTTTTT CATTGCC | 0.037498543 | 0.007241529 | 1.28E-06 |
| 2021 | 3956783 | 2 | AP1B1 | TTGGCAATCACGGACACTTTTTTCCCCTC CACCGAATGTCAGGATTGAAAGCTGCCT CCGAGTGGTTGGGGATGGTTTTCTGACC CTACGGTAACTAGATC | 7.26E-05 | 0.007011229 | 3.96E-06 |
| 1700 | 3956841 | 1 | | GTCTTCATCATGGTGGGACTGGCTCCAG GAGGGATGGTGGAGATATGAAGCCAGA TGGGGCACAGGGCTGTGTTCTGAGGGGC CTTGAGGCCTCAGAGAGGGCTTTGCACT TTATCCAGGGATTTCAGCGGGTCGTAAG CAGGAGGGGCATCTGGTTGGGGCTCTAC TGGAAGGCTCATTGCTTTGGCCAGGAAG ATGGGGAGGCTGGTGGCAAAGAAGCCC GTTGGAGGCTGTTAATGCCACCCAGGCC AGGGAGGCAGGGCCCAGGTGAGCCAGT GACAGGAGTGAAGGAGAGAGGGTGCCA GGGTAGAGAGAGCTGAAGGGGCAGTGG CAGCGCTGGGTAGCCCTGGGTAGCTCAG CACATTTT | 0.00515944 | 0.006531317 | 3.49E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1235 | 3957024 | 9 | ASCC2 | CCCTGCTGACGTCTCGCCACAACGTCTTC CAGAATGACGAGTTTGATGTGTTCAGCA GGGACTCAGTAGACCTGAGCCGGGTGCA CAAGGGCAA | 0.015136312 | 0.007228397 | 3.59E-06 |
| 1339 | 3958074 | 7 | YWHAH | CACACATGGCGCTGTCAGGATACACAAG GACAATAGCCAAAGAGTTACAAAAAAT AAATCCATGATTCTTAAACAATTGCAAC CAAAAAAAAAAAAAAGTTACAAGTATC AAAACTTTCAGATGCATTGCATTGAAAA GAAGGTTTGTGCACGTCATAATTTAAAG AGGCAAAACCAAGGAGCTACTGAAACCT CACGTTAAACAGTTTATTATAAAGCTGA TGGAAAGGAGCAAGTTGTCTCTCTGTAT CAGCTTCCCTTAACAGTTTTCCATTAATT GAAGAAAGAGGTGGGAGGGGTGAATTC ATTTTTGCATGCACAAGATGTACTGCTTA ACGAAACACTATCAGCTTGTTTTAAATG GATCTTTTAAATATCAACTGTAGCCTGGT TGGCTAATTCTTTCTAATCTTCCCCATTA CTTTCGCCTAGATTTCCCATAGATCAACA GGCATAGTAAAATGCCTCATCAGAACAC ACTTCTCCACACAATTCAAAAGGGAGC TCCTGTGGGCTCAAAGCAACCATCAGTC CAG | 6.02E-05 | 0.01323046 | 7.68E-06 |
| 885 | 3958175 | 9 | SLC5A4 | TCTTGGGTGGATCTTTGTCCCTATCTACA TCAAGTCGGGG | 0.000873066 | 0.011103233 | 8.58E-06 |
| 422 | 3960135 | 9 | CARD10 | TGCTGCGGCAGTGCCGTGGCTCAGAGCA GGTGCTCTGGGGGCTGCCCTGCTCCTGG GTGCAGGTGCCCGCCCATGAGTGGGGAC ACGCAGAGGAGCTGGCCAAGGTGGTGC GCGGCCGCATCCTGCAGGAGCAGGCCCG CCTCGTGTGGGTGGAGTGCGG | 0.042066262 | 0.010130553 | 1.11E-05 |
| 289 | 3962111 | 7 | SREBF2 | GACATACACACAACACGCAGGCGGGCA GGGTCCATAAATTACAGTGAGAGTAGGG GAGGGGCAGGAGAGAAAGAAAGCAGGT GGGGTCCAAGCACACCCCAGGGATAACA TTCCAGCCTGCATCAAGGTGGCCCTGCT GTGAGCACCCCCCAGTCTGTGCTGGGGC TCCTGCCCACCCTCTGCTCCAACCAGCCT GAGGATGAGGCACAGGGAGGCAGGGCC CATCACTCAGGAGGCCATGGGAGAAACA GTCTCCGGGAGGTGCTGCACCTGGGGAC CCAGAAAAGTAGGACTTTTTCTCCTAGG ACCCGCATCGAGGCAGGGGACCTCATTC CTAGTGC | 0.000511623 | 0.017319589 | 1.35E-05 |
| 1113 | 3962470 | 6 | | TGACAGCATGCACGAAAGCCCGCTTCTC ACATCTGATTCCAGGAGAAAGAGCGGCG TGTCCAGCAAGATAAGTTTATCCACCAT CTCGGGGAAGGTACAGAAAAACTGTGA GGATGCCAAAAGGGGAGAATGAATAGG GGGAAGAAGGAAAGGACACTCCCGCCTT TCCCTGGGGACCCTGGAGTTCCCCGAAA CATCTTTTAGGCTGGGGGGAGGGTGCTG ACCAAGAGGCCAGAGGAGAATCTTCTAT CTATGGTGTGCCTTCCCCCACCACCCCTA AGTCTGCACCCAGCACTGAGCTCCAGAC CTTGGTGATGGCTGGACTCC | 0.003098917 | 0.007741604 | 4.41E-06 |
| 804 | 3962932 | 3 | SCUBE1 | CTTTGCAGGGTATGTTCCCGGCCCACAG GGGGCTCTCCATGGATCTGAGGAGACTG GCAGGGCAGGATCGGAATCGGCACCCTG GAGAAGCTGTCGTTGGAGACGGCCTTGG CGAGACAGTGTGTTGCAGCTCCAGCTCT GTCCGCTGGGTTCAGCCCCCTCACCTTAC CTCAGTCACTAACCTCTGTGCGCTCAGC GTTCTCAGCTGTTAAGTGGACGTAACAC AGGTTGAGCATCCTTTATCCAAAATGCTT GGGACCAGAAGTGTTTCAGTGTTGGAT GTTTTCACATTTGGGAACATTTGCAGATA CATAATGAAGTAGCTTGTGGATGGACCC A | 0.000197241 | 0.010510173 | 4.00E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 190 | 3965086 | 1 | | CACAGCCGAGCCAGTGGAGCCGTTCTGG GCAGGTGTAAGGCCGTGGTGTCTCAGGG GACATCCCGTGTCACAGCCCGGAG | 0.001219026 | 0.012512162 | 7.10E-06 |
| 103 | 3965316 | 2 | BRD1 | GCGGGTCTTGTCCATAGTGTTGATAAGC TGTACATGTTTGTATATTGTTCAAAACTT AACTTATTCTGATTTTTAGTTATAGCTCT TTAATTCTTTTTCCCCGGGGAGGGGGGA GGTTTTATTTCCAAGTTTTCTAGGAACCC ATCTCCGTCTGGGCGCTGTGAGTGGGGT GGGCACGTCCGGGCAGCCCAGTGCGTCT GTCGCACGTCCCCAGGCCGTGCTGCTGG CGTCACTTTCTTTGATATGTAGCTTTTTC TTAAAGACTTTTGAATGTTTAATAATTTT GTAAATCATGCTCTTTACACAGAGTACC ACTTATTTAATAAGACGGGATGTAAATT TACAATGACAAATGTGTATTTTAAGAAA GAAAATGACATTATTTTGAATGGTACTTT GTGGAAAGAGGGGAGAATAAAGTTATG CTGTGTACATCACTTGCAGATCACCAAA AACACTCCGCTGCCCGTGACCGCCGGTG GGTGTGTCCCCGCTCCCGTCGTCCCGCCC ACCTCAAACCCCGCAGGTGTGCCTCCCA GCGGATTATTTATTGTAGAAAGTGTATTC ATTTGCTTTATAATGAAAAATACATTTGC AAAGGTATATTGATATGCATTTTTATACA GGCACATAAAAATTCAACTTGGCTTGGG AGCAGAATGCATTGCATTGTATAAATGA CTCTGGCCTGTGTGTACTTTGATTTTA | 0.000113778 | 0.025245222 | 2.10E-05 |
| 287 | 3967872 | 1 | | TTTTGAAGGTTATCCGAGGTCACCATCTG CATCTTGCCAAAGCCAGGACAGGAAGAT GCATTCTTGCCTGGTTCTTTCTTCCCCTTC AGCCTTTCCCAACACACACCCATTAATT ATCCTTCATTGTCCCACAGTAATTTCTCA GGGATCTAGTCCCATCTCTTTATTCCTTT ACTCGTTCCCTGGGATATAATTACAGCCT GATAACCAGGCTATGACTACGGACTTAT C | 0.01020177 | 0.012116789 | 1.25E-05 |
| 1473 | 3968670 | 8 | MID1 | ACTTGCCCAGTTACAACACATCTGAAAT TCTAAAGGCCCTTCCCCTACCTGTCGTGC AAATCCCCTTCCGTCTAGTCTCTGGCCTA AAACCAGTTGAGATGGACCCTCCTCCTC GGGAAGTCCTGCCTCTTTCTGAAGGCAG GGTGCCTGCTGAATCTGGTCCCTGTGGC CCTGTTTGCTCAAATG | 0.006297356 | 0.007050988 | 1.23E-06 |
| 132 | 3968897 | 1 | | TGAGCATGCAAGTCTAACTAAAGGCATT TAAACACACGTTTTTAAGAACACTGGGG AGGCTGAATGAAACACATCCAAGGGCCA CCACTTTGCAACTCCTGAACCAAGCAAA ACCAACTGGTGTCCTGTTGTATGCGTGTG TTGTAGAGCTTTAAAGC | 1.39E-05 | 0.017841672 | 1.98E-05 |
| 834 | 3971935 | 4 | ZFX | CGAGGTCGTGTCTTTTGCGGAAACATGG ATGGAGCTGGAGGCTATTATCCTTAGCA AACTAACGCAGGAACAGAAAACCAAAT ACCGAATATTCTCACATACAGGTGGGAG CTAACTGATGAACACAAAGAAGGAAAC GAGACACTGGGGGTCTACTAGAGGGTGA AGGGAGGGAGGAGAGAGAGGATCAGAA GAGATAACTATTGGGTACTGGGCTTAAA TACCTGGGTGATGAAATAATCTGTACAA TAAACCCCGTGACAGAAGTTTACCCAT GTG | 0.040585072 | 0.007638758 | 3.94E-06 |
| 353 | 3973877 | 2 | RP5-972B16.2; CYBB | CTAGCCCATCTTACTCCAGGTTTGATACT CTTTCCACAATACTGAGCTGCCTCAGAA TCCTCAAAATCAGTTTTTATATTCCCCAA AAGAAGAAGGAAACCAAGGAGTAGCTA TATATTTCTACTTTGTGTCATTTTTGCCAT CATTATTATCATACTGAAGGAAATTTTCC AGATCATTAGGACATAATACATGTTGAG AGTGTCTCAACACTTATTAGTGACAGTA TTGACATCTGAGCATACTCCAGTTTACTA | 8.88E-05 | 0.019334343 | 2.32E-05 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| | | | | ATACAGCAGGGTAACTGGGCCAGATGTT CTTTCTACAGAAGAATATTGGATTGATT GGAGTTAATGTAATACTCATCATTTACC ACTGTGCTTGGCAGAGAGCGGATACTCA AGTAAGTTTTGTTAAATGAATGAATGAA TTTAGAACCACACAATGCCAAGATAGAA TTAATTTAAAGCCTTAAACAAAATTTATC TAAAGAAATAACTTCTATTACTGTCATA GACCAAAGGAATCTGATTCTCCCTAGGG TCAAGAACAGGCTAAGGATACTAACCAA TAGGATTGCCTGAAGGGTTCTGCACATT CTTATTTGAAGCATGAAAAAAGAGGGTT GGAGGTGGAGAATTAACCTCCTGCCATG ACTCTGGCTCATCTAGTCCTGCTCCTTGT GCTATAAAATAAATGCAGACTAATTTCC TGCCCAAAGTGGTCTTCTCCAGCTAGCC CTTATGAATATTGAACTTAGGAATTGTG ACAAATATGTATCTGATATGGTCATTTGT TTTAAATAACACCCACCCCTTATTTTCCG TAAATACACACACAAAATGGATCGCATC TGTGTGACTAATGGTTTATTTGTATTATA TCATCATCATCATCCTAAAATTAACAAC CCAGAAACAAAAATCTCTATACAGAGAT CAAATTCACACTCAATAGTATGTTCTGA ATATATGTTCAAGAGAGAGTCTCTAAAT CACTGTTAGTGTGGCCAAGAGCAGGGTT TTCTTTTTGTTCTTAGAACTGCTCCCATTT CTGGGAACTAAAACCAGTTTTATTTGCC CCACCCCTTGGAGCCACAAATGTTTAGA ACTCTTCAACTTCGGTAATGAGGAAGAA GGAGAAAGAGCTGGGGAAGGGCAGAA GACTGGTTTAGGAGGAAAAGGAAATAA GGAGAAAAGAGAATGGGAGAGTGAGAG AAAATAAAAAAGGCAAAAGGGAGAGAG AGGGGAAGGGGGTCTCATATTGGTCATT CCCTGCCCCAGATTTCTTAAAGTTTGATA TGTATAGAATATAATTGAAGGAGGTATA CACATATTGATGTTGTTTTGATTATCTAT GGTATTGAATCTTTTAAAATCTGGTCACA AATTTTGATGCTGAGGGGGATTATTCAA GGGACTAGGATGAACTAAATAAGAACTC AGTTGTTCTTTGTCATACTACTATTCCTT TCGTCTCCCAGAATCCTCAGGGCACTGA GGGTAGGTCTGACAAATAAGGCCTGCTG TGCGAATATAGCCTTTC | | | |
| 1230 | 3974321 | 1 | | CTGCTAACAACGGACCCAGCCAGTGCCC ACCAAATGGCTCCTGCAGCCTTCCTTTGC AGCCACACTGAAAAGCGATCAAATGTGA AATCCCAGGGAGGCCAGAGCAATGCGG CCAGCACTCAGCTCCGGG | 0.000103742 | 0.009748928 | 6.08E-06 |
| 748 | 3974602 | 3 | RP11-169L17.2 | GGGAAGCTGCGCCTCCGCAAACGCTCAG AAGCAGCTTCGCCAGACAGCCGAACGT ACATGTTGACTGCCCGAGGCGGAAGTCG AT | 7.28E-05 | 0.01454949 | 1.06E-05 |
| 1407 | 3975196 | 1 | | GTGGAGGATGGCTCATAACACTTCTCGG AATCCTCCATCAAATGTGCACTCCACTCT CCTCTCCTTCTCTCCCCTAAATCCACATC ACCAGCTTGG | 0.013854351 | 0.006635681 | 5.98E-06 |
| 1036 | 3976688 | 2 | EBP | ACCAGGCTCGAACACTGGCCGAGGAGG AGCTCTCTGCCTGCCAGAAGAGTCTAGT CCTGCTCCCACAGTTTGGAGGGACAAAG CTAATTGATCTGTCACACTCAGGCTCATG GGCAGGCACAAGAAGGGGAATAAAGGG GCTGTGTGAAGGCACTGCTGGGAGCCAT TAGAACACAGATACAAGAAGCCAAGG AGGTCTATGATGGTGACGATTTTTA | 0.002157641 | 0.013487046 | 1.43E-05 |
| 1868 | 3977052 | 9 | MAGIX | CACCGTTGGTTAGAGACATGTAACGCAC CTCCCCAATTGATC | 1.55E-05 | 0.00881525 | 6.38E-06 |
| 1505 | 3977310 | 4 | CLCN5 | ATGATTAAAGGGGTGTTGTGGTCTTGTTT TAAATACATCACTGGAGATGTAGAGGTC | 0.023452452 | 0.007299256 | 7.03E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1303 | 3978435 | 2 | TSR2 | TGGTGGGGACAGTTGAAGCACAACCTCCACAAAG ACCAAACAGATGAACGAACGGAGCACAGCAGTGCTATGAAAG | 0.013747629 | 0.011233971 | 1.17E-05 |
| 2050 | 3979989 | 2 | AR | AGGTCCATTTCTGCCCACAGGTAGGGTGTTTTTCTTTGATTAAGAGATTGACACTTCTGTTGCCTAGGACCTCCCAACTCAACCATTTCTAGGTGAAGGCAGAAAAATCCACATTAGTTACTCCTCTTCAGACATTTCAGCTGAGATAACAAATCTTTTGGAATTTTTTCACCCATAGAAAGAGTGGTAGATATTTGAATTTAGCAGGTGGAGTTTCATAGTAAAAACAGCTTTTGACTCAGCTTTGATTTATCCTCATTTGATTTGGCCAGAAAGTAGGTAATATGCATTGATTGGCTTCTGATTCCAATTCAGTATAGCAAGGTGCTAGGTTTTTCCTTTCCCCACCTGTCTCTTAGCCTGGGGAATTAAATGAGAAGCCTTAGAATGGGTGGCCCTTGTGACCTGAAACACTTCCCACATAAGCTACTTAACAAGATTGTCATGGAGCTGCAGATTCCATTGCCCACCAAAGACTAGAACACACACATATCCATACACCAAAGGAAAGACAATTCTGAAATGCTGTTTCTCTGGTGGTTCCCTCTCTGGCTGCTGCCTCACAGTATGGGAACCTGTACTCTGCAGAGGTGACAGGCCAGATTTGCATTATCTCACAACCTTAGCCCTTGGTGCTAACTGTCCTACAGTGAAGTGCCTGGGGGGTTGTCCTATCCCATAAGCCACTTGGATGCTGACAGCAGCCACCATCAGAATGACCCACGCAAAAAAAGAAAAAAAAAATTAAAAAGTCCCCTCACAACCCAGTGACACCTTTCTGCTTTCCTCTAGACTGGAACATTGATTAGGGAGTGCCTCAGACATGACATTCTTGTGCTGTCCTTGGAATTAATCTGGCAGCAGGAGGGAGCAGACTATGTAAACAGAGATAAAAATTAATTTTCAATATTGAAGGAAAAAGAAATAAGAAGAGAGAGAGAAAGAAAGCATCACACAAAGATTTTCTTAAAAGAAACAATTTTGCTTGAAATCTCTTTAGATGGGGCTCATTTCTCACGGTGGCACT | 0.00041969 | 0.007110435 | 2.61E-06 |
| 1347 | 3981275 | 4 | NHSL2 | ACCCCCAGTCGGCCTACTGTGCCTCAGC | 0.001484083 | 0.007898961 | 8.62E-06 |
| 2029 | 3981889 | 1 | | ACAACCAACTGATCGTTAACTAAGCACACAAAAATATAAACTGGGGAAACAACATCCTACTTAATAAATGGTGCTGGGAAAAGTAGATAGCCCACATGTAGA | 0.001070147 | 0.007759571 | 5.95E-06 |
| 1389 | 3982824 | 4 | SH3BGRL | ATGGGCAGAATCCAATACCCGTTTGCTGTCAGTTATACCTGTTTGCCAGTTAGTCAGATGCTCAG | 0.000425014 | 0.007299911 | 3.97E-06 |
| 1996 | 3984554 | 9 | CSTF2 | GTGGAATGCATGTCAATGGCGCACCTCCTCTGATGCAAGCTTCTATGC | 0.01560657 | 0.006911261 | 6.59E-06 |
| 1379 | 3985558 | 2 | NGFRAP1 | AGTTTCTGTCAGCAGTAGYTTCACCCATTTGCATGGAAA | 1.89E-05 | 0.013521885 | 1.10E-05 |
| 863 | 3985758 | 9 | PLP1 | TGCTTTCCCTGGCAAGGTTTGTGGCTCCAACCTTCTGTCCA | 7.71E-05 | 0.010589385 | 6.72E-06 |
| 890 | 3988764 | 4 | RP5-1139I1.1 | AAGGGGACTTGAGTGCTGGATTTCTGGAGGAGATCAGTGGAAAATTGAGTGTTGGTC | 0.000246362 | 0.009691417 | 4.17E-06 |
| 737 | 3990584 | 9 | UTP14A | GTAGCATTCAATAAAACCGCACAAGTCCTCTCCAAATGGGACCCTGTCGTCCTGAAGAACCGGCAGGCA | 0.000438052 | 0.011094743 | 5.44E-06 |
| 744 | 3990660 | 9 | BCORL1 | CCTCAGGAACAGGAACCTTCTCTTGCCCAACAAAGTC | 0.013881148 | 0.008292344 | 8.84E-06 |
| 588 | 3991537 | 5 | GPC3 | GTACAACCCAGCCAGCAGGTCAAGGATTGGAGGACCACCCTGAACTGGAACAACTGGATTACAACAGCTG | 0.032963108 | 0.009771426 | 5.77E-06 |
| 946 | 3991667 | 4 | PHF6 | GCAATTTCCAAGGTTCATGTCAGCCACAAGGATCAAAGGAGG | 7.84E-05 | 0.009377693 | 4.41E-06 |
| 1987 | 3991676 | 9 | PHF6 | ACTGGAGCCCTCATCACCTAAAAGTAAAAAGAAAAGTCGCAAAGGAAGGCCAAGA | 0.00022254 | 0.007170117 | 5.77E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 1691 | 3991722 | 2 | HPRT1 | AAAACTAATTTTAAAGGGCTGTCAGAAG ATACCAGGTCCACATCCTCCCATGGAAC AGATGAAATG GTAAGAAGCAGTCAATTTTCACATCAAA GACAGCATCTAAGAAGTTTTGTTCTGTCC TGGAATTATTTTAGTAGTGTTTCAGTAAT GTTGACTGTATTTTCCAACTTGTTCAAAT TATTACCAGTGAATCTTTGTCAGCAGTTC | 0.000125743 | 0.008299216 | 5.16E-06 |
| 1618 | 4001867 | 2 | SH3KBP1 | ACGTAGTCAGAAGCGAGTGTCCTTTTCTT TTGCTTCAGGCTAAGAGCTGCCTCGCTCT TTGTCCCCCATTAGGATTCTATTACATA TGCAATTGTAGGTTCAACCTGTCCCTTTC CCTGCCAGCAAACCCCACCACCCTAAGA GAAATTTTAGCTTATATATGACGGTATAT TTACAAAAAGAGAAAGAGAAAATCTGG TATTTGCAATGATCTGTGCCTTCTTTTTA CCACCCTCTTGATTGGAGCTTTTGTGATG CAGCTACCATGATTCAAAAAAATTAAAA ATTAAAAAAAAAAAATCTGCCACTTATC CAAGTCCACTAGAGGCCACTGTCTTCAA AGCTTCTCTCACCCTAGCCAAAGGTCCT AAGAGGAGACAGCTGTGAAGTTGGGCGT GCTCTGTGGTACCAGCTGTGACTTTTCTA TTTCTCCTAGTTTTAGGTTGTTCATGAAA CTAGAAATGTCATCCTGCTTGATTTTTCA TCAGCCAAGTTAAACCCCTGCTTTCTGTC CTTTGCACCTTTTGCGTGAACAGAATATG | 0.000155817 | 0.008800731 | 7.41E-06 |
| 390 | 4001936 | 9 | SH3KBP1 | AGGTGTTCTCAACGGGAAGACTGGAATG TTTCCTTCCAACTTCATCAAGGAGCTGTC AGGGGAGTCGGATG | 2.85E-05 | 0.018253605 | 1.50E-05 |
| 1800 | 4004831 | 9 | DYNLT3 | ATGGCTCGGAGTCTCGGGGTCCTGGTGG CACTGCCATTCCCGCTCCCG | 3.14E-05 | 0.007135752 | 4.30E-06 |
| 263 | 4005034 | 5 | RP5-972B16.2; TSPAN7 | TGTGGGAACCCCAAGTACACCAGAGGCA CTTCTCCACAAAGAAGCTTCTATCAATG GGAAGCCTAGTGTGTCACGGACCA | 6.09E-05 | 0.014111468 | 1.22E-05 |
| 1402 | 4005967 | 4 | CASK | CGAGACTCCCCTCGACTGTTGTTGGGAT GGTGGTTAGCGTGGTAGAGCCGTCTGCT TTGAGTCACCGGGCTGGTCTAGAATATA GAACTGACAGTCCAAATGCTCATCCTTT C | 0.001561876 | 0.007092994 | 4.08E-06 |
| 1761 | 4007481 | 5 | EBP | AGGCCAGTATGGGTGCAAGGGGCCCGCG TTGGTAGTCATGTCTTTGTGGGCTGATGG CTGCGTGTGTATAGGCAGAAGTTA | 0.000111942 | 0.009912108 | 5.20E-06 |
| 837 | 4007956 | 9 | CACNA1F | CTCCAGCGCCATCTCGGTGGTGAAGATT CTGCGAGTACTCCGAGTACTGCGG | 0.030881616 | 0.008004059 | 3.19E-06 |
| 1736 | 4009008 | 6 |  | GGGATGACCTCCTATTGTGCCACGGGAG ACACAGGGCTTGAGCCCACAGCTGGAGG GAAGGTGCCATCCACACTGAAAGTCAGC CAGCCAGCCAGTAGAAATTATTTATGAT AATACAGGAACCATGGCCAGCATGACAT TTCTACTTCCAGTGGGAAGGCAGGACTT TAGGAATGAGAAAGGAACTGGGATGGA AGAGAGAGGCAGAAGGGGAAGGTGGGG GACAGTGAGGAAAAACACACTGATTGA GAAGGGACCCTGGGGACTTCTGGGATGG TGATCGACCTTG | 6.02E-05 | 0.008854541 | 6.11E-06 |
| 212 | 4011774 | 2 | SNX12 | TCCCTAAGCCCTTGCTACTTTATGGGTTA GCTTTGCAGGTTTGGTGGCTTGAGGGGT GGGGCAACTCACCACTGCCAGGTAACT CCCTGAAGGGTGGGAGTGGATTATCTTC TAGGCTCTTACCCGCGGTAGGGAAGGGC ATCAACACTGTCTTCCTTCCATTCTCCTT TCCCCCATCCCATTTAGTGCTGCCACAGG | 3.98E-05 | 0.017028115 | 1.23E-05 |
| 500 | 4011923 | 2 | ZMYM3 | ACACGAGTGGGAAGCTAAGAGAGACAC GGGAGGGGGAGGGGACCGGAACCAT TTGAATGAGAGGAGGGGATCACGGGTA GAGTGGGCTCCAGGAGGTAGGGCGAGC AGGGTGTGACGGGGGCCAGACTCTTGAG CCA | 0.004052566 | 0.008667107 | 6.03E-06 |

TABLE 55-continued

Affymetrix Probeset ID = Aff P-ID
A = Category: 1 = Non_Coding (Intergenic); 2 = Non_Coding (Utr); 3 = NON_CODING
(Nctranscript); 4 = Non_Coding (Intronic); 5 = Non_Coding (Cds_Antisense); 6 = Non_Coding
(Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease
Accuracy

| SEQ ID NO | Aff P-ID | A | B | Sequence | C | D | E |
|---|---|---|---|---|---|---|---|
| 1399 | 4015424 | 1 | | ATGCTGCGTAAGGCCTCAATCCCACTGAAAGCTGGAAGCAGTGGGACAGAAGGGTTCCAGAGAGAGGTTAAAGAAGAAAGTGAAGGGGGAGAATATGGAAATCATAGGGAGATCA | 6.21E-05 | 0.007349564 | 1.18E-06 |
| 1103 | 4019335 | 9 | RP13-347D8.6; RP13-347D8.5 | CTCTGCCTAAACCTAGGAGTAAGGTTCCTGGAGTTGTGTCTGGAGCCATGTCAGGAGCTGTGCTTCAAAATGTGCCTACAAGTGCAGTCTGGGTT | 0.000982084 | 0.007331499 | 2.59E-06 |
| 1002 | 4021793 | 9 | IGSF1 | AGCCACTTCAATGCAGCTCTGGGGATCCACCAGTAATGACGGGGCATTCCCCATCACCAATATATCTGGTACTAGCATGGGGCGTTACAGCTGCTGCTACCACCCTGACTGGACCAGTT | 0.010262873 | 0.007382385 | 5.45E-06 |
| 1698 | 4023960 | 4 | FGF13 | CCATTATGAGAGAACGTTTGAACTGAAAAAGTCCTCTGAACTTTGTTCACTAATCTTATCAAAGAAAATAGAAGCAGAGGATGTAGACAGAAACCTGCA | 0.000102061 | 0.006988413 | 4.80E-06 |
| 1625 | 4024213 | 4 | ATP11C | TGGTCAGTCGCTTCCACCAACCGTTTCCTTTTGCAGATACTGCCTGGGTCTGAACCTGATTAAAGTTCTACATTATAGGCTTCCTACTCCAAATCCTAATGTTTATTCTAACTAGTATCAGTCTGTTTCAGTCAAAATACAAACTATAACAATGAACACGCTATTTTAGAAATGTAGCCAAAATCCTTACTTATGATCTATGATTATGTTTCTTTTAAATTTTAAATGTATTCCTAGGAGTGAACGAAAGCGTTTCTTCATAGTGTTTTATGGTCACCATTAGAGCCCAAATCCTGCTTTCCCTATAGCAACTGGGTG | 0.000292246 | 0.00706917 | 3.99E-06 |
| 86 | 4025394 | 6 | | AGATGTTTGTTAATTGCTCTTGGCCTCTCATTAATCCCCTGTGGGTCATCCAGGAAATATACTCACCACTGTCTGTTCTCTGAGTTTTCATTTCCAGGCATCCGCCCTGCCTGGATCTCCTCACCTGCCAGGAACTTCCTCTCCACAAGCCGGCCATCCCAGCAAAAGTT | 3.32E-07 | 0.027696162 | 2.93E-05 |
| 765 | 4025854 | 6 | | CTCCTTCAGCTTTGCCGCCTTAGTGATGTAAGGCTGCTTTTCACTGTCATTTAAATTATTCCACATCTCACCCAGCTTTTTTG | 0.001587412 | 0.013914483 | 1.16E-05 |
| 288 | 4027060 | 9 | MECP2 | TACACGGAGCGGATTGCAAAGCAAACCAACAAGAATAAAGGCAGCTGTTGTCTCTTCTCCTTATGGGTAGGGCTCTGACAAAGCTTCCCGATTAACTGAAATA | 2.41E-05 | 0.01789865 | 1.05E-05 |
| 1667 | 4030249 | 1 | | GGCCAAAAGTGTACGTTGTCACTAGTGCCTTGCCCTCTTACATAGCCAGTAGACCACATCTTCTCCAAGAACTTCCTCAAAGAGGGGAATGCAAGCTACCTCAACCC | 0.002577437 | 0.007582739 | 2.71E-06 |
| 1675 | 4030633 | 1 | | TGGATGCGGTTAGAGTCACAGCCTCCCTTGAAGCCTGGTTTCTTCCTCCTAATTGGACTCGGCTA | 0.000126422 | 0.008284604 | 3.42E-06 |
| 352 | 4033522 | 6 | | AGAGGATCCCACTCGTGAGCCCATGCCACCAGGGCTTGGCTCCCAACCATAGAGGTGTGCAAATTCTCAACAGCCACTTGTTCTAGAATCTGCCTAAGCCTGCCAAGTTCCAGGGGAAGGGGCGGCCATCACCACTGCTGCAGCTGCCTGCTTTCTAAGCCAGCTGAGCTCTTTGGGGGAAGGGTGGCAGCAACACTTCCACTGCAGGGACTCCCTGCAAGAACTCCAACAGCTCCAGCTAGGGGCTCAGGAACAAAACTCTGATCTCCCTGGGACTGAGCCCCTAAGGGGATGGTTGGTCTTAGTCTCCACAGACCAGGAGACTTAGTCTTTCCTCCTACTAGCTCTGAGGAATCTGGGAAGCCCTGATGAGTGAGTTTCCCTCCA | 0.000972729 | 0.011250995 | 1.11E-05 |
| 294 | 4037889 | 1 | | GAGGGCGCTGCAGAACAACCTTGGAGCTAT | 0.004841315 | 0.00915344 | 6.80E-06 |
| 1056 | 4040209 | 6 | | ATTTGCAGCGGGATCGTTCTGTGACGGGCGGTGGGCAGCCCAGGCAGGGCTGCCGTTTCGTGTATCAGCCCAGAGGTCTGAGAA | 0.00587839 | 0.008940693 | 5.30E-06 |

TABLE 55-continued

Affymetrix Probeset ID = Aff P-ID
A = Category: 1 = Non_Coding (Intergenic); 2 = Non_Coding (Utr); 3 = NON_CODING (Nctranscript); 4 = Non_Coding (Intronic); 5 = Non_Coding (Cds_Antisense); 6 = Non_Coding (Non_Unique); 7 = Non_Coding (Utr_antisense); 8 = Non_Coding (Intronic_Antisense); 9 = Coding
B = Associated Gene; C = Kolmogorov Smirnov p-value; D = Mean Decrease Gini; E = Mean Decrease Accuracy

| SEQ ID NO | Aff P-ID | A | B | Sequence | C | D | E |
|---|---|---|---|---|---|---|---|
| 156 | 4041204 | 6 | | GGGTGTGGCTCCTTCCCTGGGAAACAAC ATGGGACTAGTTCCAGAGCCA TGGACTGCAGTCCTTCTCATCCACGTCTC CTTGTCTATGAC | 0.008812862 | 0.014698895 | 1.37E-05 |
| 1765 | 4044236 | 6 | | ACCACCCTTCCCAACAATCCACTAGCAA TCCAGAGGCCACCACCCCTTCCCAACAA TCTGGCAACGACCCAGAGGCCA | 0.005170366 | 0.007435892 | 4.42E-06 |
| 621 | 4046788 | 1 | | ACACGTGTGTCCCACCCATGGATGATGG CACCAGCTGGGGGGTGCACACGTGTGTC ACACCCGTGGACGATGGCATCAGCCAGG GGGTGCACACGTGTGCCACCTTCTTCCC GGCCCTGAATTGTGTGTGA | 0.000460621 | 0.011139661 | 8.65E-06 |
| 285 | 4053554 | 9 | AGRN | TGGCGGTACTTGAAGGGCAAAGACCTGG TGGCCCGGGAGAGCCTGCTGGACGGCGG CAACAAGGTGGTGATCAGCGGCTTTGGA GACCCCCTCATCTGTGACAACCAGGTGT CCACTGGGGACACCAGGATCTTCTTTGT GAACCCTGCACCCCCATACCTGTGGCCA GCCCACAAGAACGAGCTGATGCTCAACT CCAGCCTCATGCGGATCACCCTGCGGA | 0.005853836 | 0.006573388 | 4.59E-06 |
| 1487 | 4053582 | 9 | AGRN | CCGAGTGCGGTTCCGGAGGCTCTGGCTC TGGGGAGGACGGTGACTGTGAGCAGGA GCTGTGCCGGCAGCGCGGTGGCATCTGG GACGAGGACTCGGAGGACGGGCCGTGT GTCTGTGAC | 0.000183201 | 0.00684421 | 3.08E-06 |
| 508 | 4053813 | 4 | RILPL1 | CTACCGAATTGGATACGTTGAGCTCAAC GGTGCTCTCAGAAGCGCGGTGGCTCATG CCTGTCATCCCAGCACTTTGGGAGGCTG AGGCGGGTGGATCACTTGGGGCCAGGAG TTTGAGACCAGCCTGGGCAACATGGCAA AGCCCCATCTCTACAAAAAATACAATAA GTAGCCAGGTGTGGTGGCGTGCACCTGT AATCCCAGCTACTCGGGAGGCTGAGGCA CAAGAATTGCTTGAGCCCGGAAAGCGGA GGTAGCAGTGAGCCGAGATTGCCACCGC TGCGCTCCAGCCTGGGCAACACAGCGAG ACTCGCAAAAAAAAAAAAAAAAACAA TAACAACAAAATTGCTGTGCCCTCTCTCT GGGCCTTTCTCCGTATGTTTGC | 0.03724011 | 0.010183757 | 7.18E-06 |

SEQUENCE LISTING (2083 sequences)

SEQ ID NO: 1 - DNA, 84 bp, Homo sapiens
atacccttcgccatgttatcagccagacaggaggatacagtgatggactcgcagccagtcagatgtacagtccgcagggcatca

SEQ ID NO: 2 - DNA, 138 bp, Homo sapiens
tccctggtccaaaatcaagataccgaattagagttgagggtaaaaaacacatcttgatcatagagggagcaacaaaggctgatgctgcagaatattcagtaatgacaacaggaggacaatcatctgctaaacttagtg

SEQ ID NO: 3 - DNA, 49 bp, Homo sapiens
gcaaaggtttcagcgtagtggcagacacgcccgagctccagagaatcaa

SEQ ID NO: 4 - DNA, 1102 bp, Homo sapiens
cagctggtgtgccttaagagaatccctataaataacagaaaagacactccaagcattcctgtacgtggactcagagcacagagaaaagaaactaaaatgccttttggcatttcaagatatttggcactcttgtgattacatttttttacagtccattaaagagaataaactgacataatattagagaaataaacaggctgctcacacaacagactgcaaggggaagttagaaaaagctcaagcatttttttctttgtttttcgtgtgtgtgtgtgtgtgtgtgtgtgtgtgtgtgtgtttttctgacataaaaaatgtgtccatttgcattaacttgggcagatagcttgcagcaacaaagaaacacaagctttacaactcattttaaaataaaatcttttctatgtatcattccttagaaaagttctcttcttgttttaaacacattcctgataacttctaaagatgaccaaaataaaacagaatatctacagagatcattttctgaattttttgtacatccaaggataacaacataaaaaaaataaaactggacagcatttcacatccaagtgcacagaaccatttttgcaagattaaataatgtaaacattgggaacagccaaatcagcgaagaatgccaacacctcaaaacacctggtgttgccgcttcattaagtggttcaaaatccagatctataattgcgcaatattcaccgtatataaaaagaaatggatattaattttgacaaatagctgcaactgagacttctttttatttctttatatgtgtatatagtgaatttttattatttttaaaattttatttatttttttatttttatttttgcagaggagcccagagccttctcctcctcctcctcctcctctcgcctcatctgtctcccggcctgataccagatacaggttgttgatttcatcgtgggtagcaagctagtaataaatttcaaagtgctttctcttttcatgctttttgccaataactgttaccgccgttcttattctctcccttaactcattgtctttgggggagttagacaccaggaggtgccttgtcggtcatatttttcagcacgtcatc

SEQ ID NO: 5 - DNA, 228 bp, Homo sapiens
ctcctgtgtccttaaagtagtcatgggctgggaatgttcggttaatatcccgggtgatagcactgtcctggggagactcctgtggaaacataaggaaagagagggtttagttaggttaatcatgtaaactcttattcaggtttaggcaaggtcttctcatttacacactttaaatgttgcagggacatacatacacatatgtatgcccatagttactgcctcttcagg

SEQ ID NO: 6 - DNA, 216 bp, Homo sapiens
tatacaagggctcaaccgaggcttaatttaaaagacaaaaacaaaacaaaaataccacagctcaagataaagagtcctatacagaaatcacaaaaaggacagaccatctaaggaaaaattaaaaagacgacacaaggacaggctgggcagcctgggtcagggctcctggctggtgacctgctttgagtaggtttcttgcaggtacttcttaaaagc

SEQ ID NO: 7 - DNA, 142 bp, Homo sapiens
gctgaggcaccaatcataccctatacagacagctaagcacattgtgtaaggcagatgttgcccaccactcagcccattagagagctcatgcaccatcaaacccagaataaagcaataagcccaatggtgatccaaccctttg

SEQ ID NO: 8 - DNA, 34 bp, Homo sapiens
tcaggcttctgttgcaagccaatgtagggaacca

SEQ ID NO: 9 - DNA, 117 bp, Homo sapiens
gctttcatacttggagctctactgattttccatccaagccaacttgtagggttttttccttcctatcaccagaggagacagggtttaggggaatccaagaaggttgaagtcagcact

SEQ ID NO: 10 - DNA, 393 bp, Homo sapiens
gggttatcttctagtccacatgtcacataatatgtacctttatttaccttttaaactgaagttttaaaacctgggttttaaaaagagaacaactacccatcagcaattacagaagacaaaggaacttgtgtgtctgaagactgagtgttatttagcagctctttggtcagcttggattggtcacatatgtggaaactgggaaataataggggctacttacactggagaagaacactacaaatggtgtaaagagtggttttggaatgtatccagacttccttctaaaataaaaatttaaacagctgtgtttgagagatgggtatgcacaattcttgtaagaaagactgtgtagatgtttgaggtccccttagtccctgatgctaccattgttcc

SEQ ID NO: 11 - DNA, 163 bp, Homo sapiens
gggcaaaatattcctggagtgctgagcaatacatgtcacagtctccaattttttttttattcttacgttagttcagattccactgtatccaatatgtgcttgagagtgaaaattgtattagtttctattgtaatctatctccatttcgcctcgagaaaaatta

SEQ ID NO: 12 - DNA, 124 bp, Homo sapiens
tgtcgaggcccggttggctttcagaggcgtatccatgggagtaggtgtcatgtatcaaataggagattcaaagtcagctgttaccacggctacagaaatgccagtcttttcctaagagtgcgaa

SEQ ID NO: 13 - DNA, 28 bp, Homo sapiens
ccgggtatcagatggttattatccgacc

SEQ ID NO: 14 - DNA, 332 bp, Homo sapiens
gttgcaactatctatgctgcctgtagcagacacactccagctctaaggatacatatagaatgaaagtaaagggatgaaaagaagatgctccatgcaaatggaaaacaaaagacggtaggggtggctatacttacatcaggcaaaatagacttttagtcaaaaattataacaagagacaaaggagctcactatataattataaagggctaattcatcaagaggatataaaaattataagtacatatgcacataatgtcagagcacctaaatatataatatttacataactgaagggagaaacagcaatataataatcgtagcggacttcagta

SEQ ID NO: 15 - DNA, 593 bp, Homo sapiens
ccttgacctgggaaagccattactcttgtgtctgctactgccctcccacagtcaccccaatattacaagcactgccccagcggcttgatttcccctctgccttccttctctctgcactcccacaaagccagggccaggctccccatccctacctcccactgcatcagcagtgggtgttcctgcccttcctgagtctaggcagctctgctgctgtgatctgcacaccctccaacctgggcagggactggggggatgcagtgtgtgttagtgcccatgtggcattgtggcactgttgccccccatggcggcatgggcaagatgaccttccattagcttcaagtcttgttctcttgtctgtggtctgtttaatatgtgggtcactagggtatttattctttctcccatccttacactctggatcattgtgcagacttaatcagggttttaacgctttcatttttttttttttttttttttttttgagctcaaagagagttctcattttccctattcaaactaatacccatgccgtgttttttaccttggatttaaagtcaccttaggttggggcaacagattctcactcatgttta

SEQ ID NO: 16 - DNA, 620 bp, Homo sapiens
ttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatg

SEQ ID NO: 17 - DNA, 564 bp, Homo sapiens
tcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacg

SEQ ID NO: 18 - DNA, 413 bp, Homo sapiens
gtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactg

SEQ ID NO: 19 - DNA, 470 bp, Homo sapiens
cccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaata

SEQ ID NO: 20 - DNA, 560 bp, Homo sapiens
attagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaata

SEQ ID NO: 21 - DNA, 234 bp, Homo sapiens
ggcttctgacgccaaatgggcttcccatggtcaccctggacaaggaggcaaccaccccacctccccgtaggagcagagagcaccctggtgtgggggcgagtgggttccccacaaccccgcttctgtgtgattctggggaagtcccggcccctctctgggcctcagtagggctcccaggctgcaaggggtggactgtgggatgcatgccctggcaacattgaagttcgatcatgg

SEQ ID NO: 22 - DNA, 36 bp, Homo sapiens
gtgatttctgtataggactctttatcttgagctgtg

SEQ ID NO: 23 - DNA, 70 bp, Homo sapiens
agaggatgtccatgttcaatcaccactgtccaaattcagaagctcagaacgctggactctccctttgcag

SEQ ID NO: 24 - DNA, 72 bp, Homo sapiens
agaactagcatgtcttcgtggccgatttgacaagggcaatatatggagtgcagaaaaaggcggaaactcaaa

SEQ ID NO: 25 - DNA, 39 bp, Homo sapiens
aagaccacccaggaaaccatcgacaagactgctaaccag

SEQ ID NO: 26 - DNA, 176 bp, Homo sapiens
gtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttc

SEQ ID NO: 27 - DNA, 130 bp, Homo sapiens
cgtttacggcttccacttgagtatatggcaatctgtgccctttgtgcaaaagatcctgtaaaggagagaagagctcatgctaggcaatgtttggtgaaaaatataaatgtaaggcgggagtatctgaagc

SEQ ID NO: 28 - DNA, 127 bp, Homo sapiens
aacaagatgaacaagtcggacttcctgggaaaggggggaaggccaaggggaaaaaaacacaaatggctgaagttttgccttctccgcgtggtcaaagagtcattccacgaataaccatagaaatgaa

SEQ ID NO: 29 - DNA, 48 bp, Homo sapiens
gtcccaggcggtctagcagtgatgagcagggcctctcgtattcatctt

SEQ ID NO: 30 - DNA, 57 bp, Homo sapiens
aagagatactcagagatggatgatcattatgagtgcttgaatagattgtctcttgac

SEQ ID NO: 31 - DNA, 156 bp, Homo sapiens
agccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaag

SEQ ID NO: 32 - DNA, 51 bp, Homo sapiens
attaattaaagttctgattcagaggggatatgattcggatcctgtgaaggc

SEQ ID NO: 33 - DNA, 327 bp, Homo sapiens
aaacgctggcgtccgtttctgctgagagcgtggggctttctctgcaagtggggggtgggagatgagggtttggatgagggtgtgggaggaccctaaactgattcccatgctagttggagaaagaaaggtgtggatgaggataaagttttcatggtgaccagggtgaccctccgctcagagggacgagcggagcccggcaaaaccagtcactgccttgtagttccaagctttggggatgatcagctcccaagaaattgctgtggggtgcgggggctgtgggtgacccaaattgggcagagggcctacaggtctgaggctgcctgcaca

SEQ ID NO: 34 - DNA, 111 bp, Homo sapiens
catttctctctggtgtggcgagccgagcagatcgctgggagagaaatcggaaaaggggggagaggaaaaggaaaaggggacttggagagagactttgtgcttcaatgtttc

SEQ ID NO: 35 - DNA, 31 bp, Homo sapiens
tttgagtcaggttatctctgtcgctcaagct

SEQ ID NO: 36 - DNA, 278 bp, Homo sapiens
acatttgtctgcttgggctgtcataacaaaataccatcgactagtgtaaaaataaaaatctattatctctcagttctggatgctagaagtcccagagtaaggtgtccatatatttagtttctggcgaaggctcttcctggcttgtagtcagtgccttctctgtctgccctcacttggcctatccacctgtgaacacaaataaatatctctgttgtttttttcctctccttatgtgaacatgtgtcctatggaattagggcctcactcttgtgacttca

SEQ ID NO: 37 - DNA, 348 bp, Homo sapiens
agtgagacattgtggcctggaagtctttcagacacccactcagagaagtcaagtttaaagtggatgttcttcagagaatttttcatttctgaaaatgtgttttgcttatagaatataacagagttgactagaaagagagaaacaactgcatactaatcttttaaagcctttaacagttgcttttaaactttctttttaaatgtttcatgactcttcacctatttttttttaaatggggacgaagagatatgaaaactgagacataagacaaatacctagaaacctctaagactgcacatatgatttggtagaagtctgaaggtatacacattgtaagaggcagaccta

SEQ ID NO: 38 - DNA, 29 bp, Homo sapiens
cagggtgctaatcatgatatttggttaca

SEQ ID NO: 39 - DNA, 164 bp, Homo sapiens
ctggccctgtgatataacacagatcagcaatggattcacaatactctctggctatgtgacaacaagatgcaggtcacccagcaactcgacacttcctcagaccactacaggtcaaagtcaattcctgatccaactagaaatgtcacgaacatgcctttcagatg

SEQ ID NO: 40 - DNA, 122 bp, Homo sapiens
gatgagactaggcagggtgacaaggtgggctgaccgggagtaggagcagttttagggtggcaggcggaaagggggcaagaaaaagcggagttaacccttactaagcatttaccctgggcttc

SEQ ID NO: 41 - DNA, 28 bp, Homo sapiens
ttcctttttatgtcaacgacgcccatag

SEQ ID NO: 42 - DNA, 186 bp, Homo sapiens
atgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctga

SEQ ID NO: 43 - DNA, 40 bp, Homo sapiens
agcacaatggctggaggtcagatgcccactaggagatgct

SEQ ID NO: 44 - DNA, 108 bp, Homo sapiens
ttttggtcttaggtggactagcatctgatgggacaaaatcttcatcatcagttttttcatcaaaatctgagaaatcttcatctgaatccaaatccattgtgaattttg

SEQ ID NO: 45 - DNA, 170 bp, Homo sapiens
acaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagacc

SEQ ID NO: 46 - DNA, 2260 bp, Homo sapiens
gcatcctggtctatcgagtgggtcattgtggtggctgccgcctacctaaccaaacctggtcccacgggccagctctcactgtggggcagccagctggagggacggggccagcttgccccaccccgcccctcccctccacagcagagagtgccctggctccatggggcccagcacaagctctggaggccacaggagtgcctcccctccagggcctggcaaggctggctctctgcagggctggtcaggtcagctgccttgatttccctctcccaggggcctgatgtcatcattcaggggcagcctggggacttgagggaggatgcagttcccactgccttctcccgtcctcccctccccttcccttgcttctccttctccttcctgcttccacgtcctgaccccctggccctccccagcccggccccttagcctcccctccctcccggcccctcactccccccctaccagggctgccctgtgctagcgcctgcctgtgtgaatgtctaatctccaattttattcgctgggctccagcccatttgcataatccacacagtcaccctggttttaattgcccacaactctgcagaaagatcatgtggttaagtggtaaatcataattagataaataattggtttggccacagcaagctgcttttgttacacctgccatctgctggacccgttttttcttctggccagaacaatgcggttctgatgacagagcatgctgcttctctcttctgggggggccggagggggctgaatggaggggctcggaagcagtgcctggaaaattgcccggttgctggggtccgcgcctggcctgcgcttctttctctccaagcgggcacaccacacactcgccattcattacccggcttggttaatgcatcagagtggcaaatttgacttctttgcagaaaagggagggaggaaaggggcctggaggaggagggggaccagccagggctgcccaaggcctggcctgcctgccggttgtcggtggccccgatgggccagggcaggaggcctgctgtggagggcctgggcccgatccctggggggttggggggggggggcggaggggacaggcgggcaggggttggaaccgccagacctccctgccccaccgcggtcagcttctccatctgctctccaccgaagcctcctttattttccatgccccaggccccatctgtgagccctgagtctccaggggaattgtggctccctggctggacggtcgcctggccagggccttccttggggctgctggcctgcctttcatgctgtccttccagcaagctcttagctcctagacttcaggaacggtttcaaattgtccttccttcactcgctccctcacgcatacacgcacacattcattcattcagcaaacgcccgtggagcctcttcctacatcagagtgcaggttcgaacttggtctccgtgggtcagatggccgctgtgggatgtgagcaagtttctcagcctctcagagcaggtttcttcctctgtaacacaggagtcattattgtccctgccttctgggcctattaggaggatcaaaggacagaatgtggataaagtctgtcgagtgacacctgcacgaaacacaggcccagtgtctgtggctggtgagtgcgtgactgctggtcatgcccgctcccggggagggcgccagcgccgctcaccttgggcatcattggaggcccacgaggctgtgctgaacatgctgaaggaagaggtaccagtgccatgggaagggcccaggaatgaggagccttggaaagaaaccagggggccaggggaacaggcagaggggcggtaaggaagggcaggttctctggggcctgcacaggccaggacgttcctgtctctgttgagttcggactggcaggttctctggagcccacacaggccaggacgttcctgtctctgttgagtacagaccggcaggttctctggggcccgcacaggctgggacattcctgtctctctcgagtacagaccagcacatggtcctgctctctggcccctgcatcccctccagactgcgttctggaagccctgcccaggcctcacacgctgccccaagggtctttattacctggggtcttctagcattttcctctggagaaactcaggaagcatcctttctctgcatcctttctctttgggggcccagcttctccttttcagtttgacagacacagcctgaatgcccaaggcccctctgcggagacttagagactta

SEQ ID NO: 47 - DNA, 82 bp, Homo sapiens
gacagagtccgttccgtgtgacatcaacaaccctctacggaagccacctcgctattcagacctgcacatcagtcagacgctc

SEQ ID NO: 48 - DNA, 73 bp, Homo sapiens
catgggcagatgtagtaaaacttggtgcaaaacaaacacaaactaaagtcataaaacatggtcctcaaaggtc

SEQ ID NO: 49 - DNA, 150 bp, Homo sapiens
gtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctca

SEQ ID NO: 50 - DNA, 31 bp, Homo sapiens
aggatgcaggagaacttgactttagtggtct

SEQ ID NO: 51 - DNA, 118 bp, Homo sapiens
catttctatggttattcgtggaatgactctttgaccacgcggagaaggcaaaacttcagccatttgtgtttttttccccttggccttcccccctttcccaggaagtccgacttgttca

SEQ ID NO: 52 - DNA, 43 bp, Homo sapiens
caccaaggacacctacgacgcccttcacatgcaggccctgccc

SEQ ID NO: 53 - DNA, 155 bp, Homo sapiens
cagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaa

SEQ ID NO: 54 - DNA, 63 bp, Homo sapiens
taatgctgcggacaacaaacaaagggacccaaaaatgtcttgtattagagtcacaattgatcc

SEQ ID NO: 55 - DNA, 32 bp, Homo sapiens
acaaggacgggattggcgatgcctgtgatgat

SEQ ID NO: 56 - DNA, 297 bp, Homo sapiens
ccagtgccagatcattaccagagtcactgtgttcatcctacaaaatcagcatcatatccaaattaagcagaataaaatgcgtcctcaatgaaaaaaggatttataaacatctgcccaaatacctcattctaggaaattgtttctgataagatgccaaacttagaattctcaagaactgaggggaaaaaaacacttgagggcagcaatacatggagctcagttatgattactttgttcccttcatactcacctcatcactatcaaactcattatcatttgaaacaagccgaaagtctc

SEQ ID NO: 57 - DNA, 109 bp, Homo sapiens
atgataaggatgatgactctcttcctgcagaaactggccaaaaccatccatttttccgacgttcagactccatgacattccttgggtgtatacccccaaatccatttga

SEQ ID NO: 58 - DNA, 63 bp, Homo sapiens
ttgttattgaagatgataggattgatgacgtgctgaaaaatatgaccgacaaggcacctcctg

SEQ ID NO: 59 - DNA, 110 bp, Homo sapiens
gatcatcttcatctgactcttccaggtactttataggtttctttgcccgtacagattttgcccgaggagccacagctgagtcaaagtccatatggaagtcatcactctcc

SEQ ID NO: 60 - DNA, 208 bp, Homo sapiens
gcaggactgcagatctatggaaattgcctggaagagtcagctgtaagggatgagaatcctgagggtaaaagagaaaagggaaagactcctctttgatcttatgaagctgaaataacaagatcttaaacatgagtgagaatctgttgccccaacctaaggtgactttaaatccaaggtaaaaaacacggcatgggtattagtttgaata

SEQ ID NO: 61 - DNA, 70 bp, Homo sapiens
gtccctaacgtactggacagagctaggaaagcaaacccatttgcttcttcctgcaggaaaccccttgagg

SEQ ID NO: 62 - DNA, 105 bp, Homo sapiens
ccagagccacagtatgctgagggtccacgcattacatccttccatctatccaccactaaaccacagccacagtacactgagggtccatgcgtcacgtccctctgt

SEQ ID NO: 63 - DNA, 94 bp, Homo sapiens
ttcaagtggagctctcctaaccgacgcgcgtctgtggagaagcggcttggtcgggggtggtctcgtggggtcctgcctgtttagtcgctttcag

SEQ ID NO: 64 - DNA, 290 bp, Homo sapiens
gtgtaccagcgcatcaataacggtgtcccaatagcagcttctaattaaattttatcacagtcctgaatgcaccgctgacccacacactcttccaagtgggtccgattcacaggatatttgcgcagttccgcagatctgcagatttgaagaggtatttattctcatttctgccttcccagtccagcagaagttctaatttgtggacggcagctttggtaattaacaaagtgtgttctgtgaagtgaagcaggaaaactcaggactggggagtctcgctttgggtatttata

SEQ ID NO: 65 - DNA, 157 bp, Homo sapiens
ccaggagaaagattcacttgtggttcaagtcaaatgttcagaatcataacaggccagaaaggtttgatcccgagcacaagcccacgagggaggggaccaaaacagaccaaaatgagacaacaaccccatataaaaagatgaactggcggcttcacac

SEQ ID NO: 66 - DNA, 212 bp, Homo sapiens
gaatcacaagctgtcgcaggttttaaaaaacagagacactgaagaatggacgggtcacgcccaggacggatgcgatgccgtggaatgtgctgaagacagatgggggcgctgcgggttcagatggcctccacgtagttggccggcagcatccccgtgtcgccggtgcgctccaccgtcccgtacatccagccgtcgtcgatctgctgcacgtt

SEQ ID NO: 67 - DNA, 114 bp, Homo sapiens
gacaatttcacatggactttggaaaatatttttttcctttgcattcatctctcaaacttagtttttatctttgaccaaccgaacatgaccaaaaaccaaaagtgcattcaacct

SEQ ID NO: 68 - DNA, 113 bp, Homo sapiens
ttcaagaaatagtgcatatctcgtctatgctggccgctgcagcaacacagaaacagggcctgtccactcctcaggatgctttaaagaacagacagacgagctggcaggaacct

SEQ ID NO: 69 - DNA, 210 bp, Homo sapiens
atggagtggacgctagcagccaacagaaggaaagcaggctcccgctgctccagccatttctgctatgcttacctgctgactcccgggacagatatcttgctgcctttgaggttaattcaccaaactctgaactgtctgaattctgtggaagcagaatatattgaggtcctgaccacggtgtccagccctgctgtagaactatgtggatca

SEQ ID NO: 70 - DNA, 246 bp, Homo sapiens
ctcaggatgtccaccagaaaccaggagtcaccatcctcttaagggtggtgcctgtcctccagagagcatatcactgggttcaaaccccagctcctaccggcaaagcccggggcctccacctgggtgttcccatccatgaagcggggatacacagtgtggagcccttgggaggttggggagtgtgcctgccctcaccgcgcatcagctcataaatacaacaacagttgccttcacgtgctgatgctc

SEQ ID NO: 71 - DNA, 213 bp, Homo sapiens
tgacccatgaccttgccgcatgaggcctgagggcatggtgtccagagtcccagagcagatcaggccccaaagtcctgctggaccccccagccaccgtgagctcctccgtgtggctagggagctgctgtccagaggcggaggtaaacattgatccctcctgcacactcagctctctcatggaagtcggagccctcagggtcacctgaaaactct

SEQ ID NO: 72 - DNA, 115 bp, Homo sapiens
agaatgaagcatcctgcaggagccctggctcgatgcctggtagccactataaataaagaagaaccagcaggctgtgtggatgcaaggcccagtgctcccctgttctctgaggagg

SEQ ID NO: 73 - DNA, 31 bp, Homo sapiens
cctgtgaccagcagcatacgggctttggggt

SEQ ID NO: 74 - DNA, 448 bp, Homo sapiens
ctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattca

SEQ ID NO: 75 - DNA, 31 bp, Homo sapiens
attattttgattgctggaataaagcatgtgg

SEQ ID NO: 76 - DNA, 129 bp, Homo sapiens
agtcacaccggagcctggggcaagacagtgattgaatacaaaaccaccaagacctcccgcctgcccatcatcgatgtggcccccttggacgttggtgccccagaccaggaattcggcttcgacgttggc

SEQ ID NO: 77 - DNA, 324 bp, Homo sapiens
tctacagctggaggcgaaatctctcatgttgtcccttagaggatcaaatgactcccaagtcagaatgggtctcggggctcactctctggatggagcccctagaagcctcttacctgtgcccccagcaatcattcccaggtgatcggccagtgtttttttaggctcactcgtctggtctggtctgattccaagattccctggaaacacagagaatgcttatgacctctgcagttcttgcctaaagagactgcaaaagatcactgacattccttaggactcccaggaggcacgtccagctaagggactgtctgcaccattttaagc

SEQ ID NO: 78 - DNA, 129 bp, Homo sapiens
cactaatatgcagaacgtggggtccacagagacgcagatgcatcaaccagagagcgagagaagcgtctctggagctgggataggccactgtgtaagatgcaaggctggagagtgggtatctgccaaccc

SEQ ID NO: 79 - DNA, 39 bp, Homo sapiens
gctattactccaaagcgactcctcacatctataaccaca

SEQ ID NO: 80 - DNA, 29 bp, Homo sapiens
tgggattccctggacctaaaggtgctgct

SEQ ID NO: 81 - DNA, 343 bp, Homo sapiens
gcgtgcctgggcatttaacaaaggcaagaaggaaaaaaaggagaaaattggggattgagaaaattgaattaaagaagaaaagattgatcagattatttgaagagaaacctcatcacatcccaccgttgtttgcccccttcccgaccctgtgctctctcttccgattcagattcaaaagcattaactgggcacctacttaagctagactgtatgccaagctcctcgcatacaatttcctacacttttaaagttgcaggctttgtaactgctcttagcagaggcaggttctgctttagaaagtttgcataccatcatttttctcttggttcttaatcagcgaatc

SEQ ID NO: 82 - DNA, 420 bp, Homo sapiens
gatccatttaggtcagctttagtcagaactgtaaaatcagcaaacataagaaaaacaaaacctagtaatacatacaaaagctttcatgggttctagaaccttcttaactgctgattcatgtggagggcattaagagttgaaaaggcttatatggttaactaccttagactatatctacagcagggtctggtttgccagaacaagtttaaagtggctgtttattaagtttgctattttcagaattgaaactataagaccgccatttgacactgaaacttgcgtgaatcctaaattgcatcaattatctatttgataaaagcttattctaatttaaaaccttatagagtaagagactgatatatatagcagtcttaaagatcacgtcatctgccttacattagtccagtcacgtgcttcgta

SEQ ID NO: 83 - DNA, 110 bp, Homo sapiens
ggggacttacacttgccagcacagcacactcctctggtcttgggcagaaatccagccactgccccatgctgccagacctgatcgcagacagccactgttcccattccttg

SEQ ID NO: 84 - DNA, 279 bp, Homo sapiens
tgtccagcagctcactctgttcttagggttcatgttatgcaacataaagtacacagcatcacagatgaagtcatatttttttaaaaaatctaatcaaaccaccagacctaacctccagtctataggaaattcaggagattgaggaacaaattaagtgatgtcattaggaaaaagtcagacaattaaaaaatgtaggtgaggcactctaaagcaactagcttggactcttcaaaaaattgtcatgggaaattagaatggtaccgccaactctggaaaaca

SEQ ID NO: 85 - DNA, 250 bp, Homo sapiens
cagctgcagccactacgcagttttaccccagttccacggcacatgaggagaggaccaacattattctattttggcagcacgtgctttcaacccatctcacaaaacagtgtcaccaaccagatgtgccaagagccagagcaggtgaagacacctacagatgctgcctcctctggacactgcctctgggtgcctcagctctgcacccagagggatgcaaaagagatccccgcagcacactttgagatggcta

SEQ ID NO: 86 - DNA, 170 bp, Homo sapiens
agatgtttgttaattgctcttggcctctcattaatcccctgtgggtcatccaggaaatatactcaccactgtctgttctctgagttttcatttccaggcatccgccctgcctggatctcctcacctgccaggaacttcctctccacaagccggccatcccagcaaaagtt

SEQ ID NO: 87 - DNA, 39 bp, Homo sapiens
aaggcaggcagtcatcgccggagtcctaagcggcaaaaa

SEQ ID NO: 88 - DNA, 37 bp, Homo sapiens
gccaggcacgcaaatatggggcccttgtgtggtgtgc

SEQ ID NO: 89 - DNA, 381 bp, Homo sapiens
ggattatgccggtttctactgtgtcatgcaggttgtcagggaagtgagggaaagccaggagtcacagatctcacccagcttccatgcaatccaaagggccgttctcactcccaatgtgcccccggacccaacagcactgagtctgtttccaggcagtgggtaagcagggctgagaactttccccaggcaatctgcttcccagctgtgaaagcaaatatggctttccttcttcccccacctgtggagactgcacaccggattcacgcccttccctgagttctggccaggagtgttctcaatcagctcaaattgttacaaagttcagctggaggttttcttctcctgtggcttttcccggcatctctggtcgccctcctgaag

SEQ ID NO: 90 - DNA, 51 bp, Homo sapiens
tggtttttcagtacagccagacagattggaattgggtaaacctgataataa

SEQ ID NO: 91 - DNA, 94 bp, Homo sapiens
aagcattgaatggagcacctacctgcccccagtcagaacatccccatctcgactggtgatgagtcaaatgcagggatcacagtgcatggggaga

SEQ ID NO: 92 - DNA, 74 bp, Homo sapiens
ggagtcatttatgcagctccatcttctctgcccttgtagttcctttactccatcctccatcttagggagttttt

SEQ ID NO: 93 - DNA, 36 bp, Homo sapiens
ggaagggactcggagaaagctacaagctggggccct

SEQ ID NO: 94 - DNA, 116 bp, Homo sapiens
aagataggacatgtctgagagctttggagaaaatcaagattcagttagaaaaaggaaataaagaatttggtgaccaagctgaagcagcacaggatgccaccttgactacaactact

SEQ ID NO: 95 - DNA, 104 bp, Homo sapiens
cagagattaaggaaccgaggagagagagaccgggaaagggagagagaaagggaaatgaggaggagtagtggtttgcgagcaggttctcggagggaccgggatag

SEQ ID NO: 96 - DNA, 30 bp, Homo sapiens
agcagttcagcttgaatcagagtagagtgg

SEQ ID NO: 97 - DNA, 41 bp, Homo sapiens
ggagagaataagaacggcggtaacagttattggcaaaaagc

SEQ ID NO: 98 - DNA, 108 bp, Homo sapiens
gccaatgtccagattgctagtatctcagaggaactggccaagaagacggaagatgctgcccgccagcaagaggagatcacacacctgctatcgcaaatagttgatttg

SEQ ID NO: 99 - DNA, 152 bp, Homo sapiens
aaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagct

SEQ ID NO: 100 - DNA, 99 bp, Homo sapiens
ctgatcctccagtggcaccgactgtgacagaggtgggagatgactggtgtatcatgaactgggagcctcctgcctacgacggaggctctccaatcctag

SEQ ID NO: 101 - DNA, 29 bp, Homo sapiens
atacagtggagcatcgtgcccgaagtgtc

SEQ ID NO: 102 - DNA, 119 bp, Homo sapiens
ttggttcctgggactttagaagtgaagctctttcttcgtctacccaattgccccactcttctgctggtgcattccaatcagagttgggatcagcagaagacagaccatctaaaatttaa

SEQ ID NO: 103 - DNA, 708 bp, Homo sapiens
gcgggtcttgtccatagtgttgataagctgtacatgtttgtatattgttcaaaacttaacttattctgatttttagttatagctctttaattctttttccccggggaggggggaggttttatttccaagttttctaggaacccatctccgtctgggcgctgtgagtggggtgggcacgtccgggcagcccagtgcgtctgtcgcacgtccccaggccgtgctgctggcgtcactttctttgatatgtagctttttcttaaagacttttgaatgtttaataattttgtaaatcatgctctttacacagagtaccacttatttaataagacgggatgtaaatttacaatgacaaatgtgtattttaagaaagaaaatgacattattttgaatggtactttgtggaaagaggggagaataaagttatgctgtgtacatcacttgcagatcaccaaaaacactccgctgcccgtgaccgccggtgggtgtgtccccgctcccgtcgtcccgcccacctcaaaccccgcaggtgtgcctcccagcggattatttattgtagaaagtgtattcatttgctttataatgaaaaatacatttgcaaaggtatattgatatgcatttttatacaggcacataaaaattcaacttggcttgggagcagaatgcattgcattgtataaatgactctggcctgtgtgtactttgatttta

SEQ ID NO: 104 - DNA, 152 bp, Homo sapiens
cctacatgtctatgttcagaagctgccttgatgccacatgcgggaggctggaaacgctgaaggatgaccactgctcagcagcagtctaccagtgatggatgagagttggtgcacaaataccccagctcccttgcctctcagtttggataatc

SEQ ID NO: 105 - DNA, 94 bp, Homo sapiens
agccccaatatgtcaccgagctgcagagcccccagccccaggcacagccaccgggtggccagaagcagtacgtgacggagctcccggctgtacc

SEQ ID NO: 106 - DNA, 82 bp, Homo sapiens
aaggcagaagtgactcccgaaattctctttctggactcagaaggaaaccaaagcaattgatgacaccgcatcccatactaaa

SEQ ID NO: 107 - DNA, 74 bp, Homo sapiens
gtttgcagattacgaagcatttgtcattcagactgcccaggacatggaatcctggctgaccaaccgggaacaga

SEQ ID NO: 108 - DNA, 147 bp, Homo sapiens
catttccaaggggtaggtgcacaggtcaacagaactaaactacagtgatcttcccttagatccttttctactgaggtgaatagctcaaaagacaaggatgcctttagtccaggctaacccctgtagcctctacgcaattaacacaga

SEQ ID NO: 109 - DNA, 80 bp, Homo sapiens
catcgccagcctcacggggtctgtagtgaacctcgtcttcatcctcatcctctccaagatctatgtatccctggcccacg

SEQ ID NO: 110 - DNA, 82 bp, Homo sapiens
tctgacaggactaacacttaccagcctctatgcactatataataactgggagcacatgaaaggctccttgctccaacagtca

SEQ ID NO: 111 - DNA, 329 bp, Homo sapiens
tcagcttctgagtttgccatcagtttttattatctccttattttagtttagaactccacatatacaaatgggtatttatcctttttcctcctgtattcttcttcttggaaaatgacatgatggctccaacaagtcatccaagccctaattctagtaggtggtcatctctgtctcttctctttcatgttccttataactagtctgttactaagtcctgccaattctacctcagaatactccctttcagtccccctactgctgctctgttgagcattgaggctctgcacttacatcaggccccatctgcatctctatgtccagtgttactc

SEQ ID NO: 112 - DNA, 172 bp, Homo sapiens
gcacttgacagagccaactttaacacagactttgagaagtggccctgatgaaaccctggccaacagccagccagccactacccaaaaatgtctgcctgaaagcagctccaggaggcaggccatggggagtggaagtcggggagaaactggaagaggcgccaagcagctgtca

SEQ ID NO: 113 - DNA, 148 bp, Homo sapiens
agttccactaccgaccgcggggcagtgactcttgcctcccatgtgactgctaccctgtgggctccacctcgcgctcatgtgcaccccacagcgggcagtgcccctgtcgcccaggagcccttggccgccagtgcaacagctgtgacag

SEQ ID NO: 114 - DNA, 236 bp, Homo sapiens
gatgtgaattgccacacccttctggaaagttatgtagcagtatctgctaaaacttaatattcacatatattagacttaggaatttcattttgttgaattctaaagacataaaaatactgatgtcggagaaatcgtgattctgaaagattttaaaatcagaagatttagaaatacattgtttgttcccagtgccactatggccaggtaaatctcaggggctttcttagcccagaagg

SEQ ID NO: 115 - DNA, 103 bp, Homo sapiens
gctgttggttcaaacttttgggagcacggactgtcagttctctgggaagtggtcagcgcatcctgcagggcttctcctcctctgtcttttggagaaccagggc

SEQ ID NO: 116 - DNA, 222 bp, Homo sapiens
gctggtgtgtctcatcttctggctgattttcagcatcatgggagttaacttgtttgcgggaaagtaccactactgctttaatgagacttctgaaatccgatttgaaattgaagatgtcaacaataaaactgaatgtgaaaagcttatggaggggaacaatacagagatcagatggaagaacgtgaagatcaactttgacaatgttggggcaggatacctggc

SEQ ID NO: 117 - DNA, 30 bp, Homo sapiens
tctaggaatcagcttgcaacagagcacaaa

SEQ ID NO: 118 - DNA, 58 bp, Homo sapiens
ggagacatccacctgtgatatttgccagtttggtgcagaatgtgacgaagatgccgag

SEQ ID NO: 119 - DNA, 64 bp, Homo sapiens
ttagaatgcttagtgtcgattttgaagtgtatggttgaatggagtaaggatcagtatgtgaatc

SEQ ID NO: 120 - DNA, 252 bp, Homo sapiens
ggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagc

SEQ ID NO: 121 - DNA, 88 bp, Homo sapiens
catttgagatgcagatcatcaaggccaaagataactttgcaggaaattacagatgcgaggtcacctataaggataagtttgacagctg

SEQ ID NO: 122 - DNA, 342 bp, Homo sapiens
agtcagttgtcatggggtcattccctaggcccccttcctatcagcctctacctaaagaagctagataggaagctaagcacagccatggttgggaggctatatctaaagctcatgaggggtgatcccggggttaccagccttcagcactccctctagcaacaccccattctcttacctagcggggatttgtacctttccactgaggcctctccatgctccttccctacctttcatggcaatactttggcctgcctcttatcctggtactaagttgaagtaaagctcaccctttacttccctacttgaaagttctactctgagccttgactcttagccacagtg

SEQ ID NO: 123 - DNA, 104 bp, Homo sapiens
tgaggggctgcgtactcaaatccgagagctctgggacaggttgcaaatacctgaagaagaaagagaagctgtggccaccattatgtctgggtcaaaggccaagg

SEQ ID NO: 124 - DNA, 101 bp, Homo sapiens
atgggcagtttgacaaaagagccaccctctgagagaagcaagaaatctcctcggtggcctaaccaggcactctacctgcatcgctccaggaaactgctatg

SEQ ID NO: 125 - DNA, 104 bp, Homo sapiens
aggaacaagtcctatttgatgaagatacctcagggagcctgggagcctatggaaccaacagtgccctcgactctgtcctttccaggatggccactgcacactgc

SEQ ID NO: 126 - DNA, 114 bp, Homo sapiens
agagagggaatacaaagtccacatcaaccccaactcactcttcgacatccaggtgaagcggattcacgaatataaacgacagctcctcaactgcctccatgtcatcaccctgta

SEQ ID NO: 127 - DNA, 130 bp, Homo sapiens
taacagcattgttcccatccaggtagcaaggtcagccctttccattgcctcacaggcccttggagccctcacaagtgaggatctcatctgttacccccacctctcaactcaatctctggttcgctactag

SEQ ID NO: 128 - DNA, 284 bp, Homo sapiens
cgcctcgggtacttacaatccagtgacgattataagttcagtttcaccgggccggagcgaagggaagaggaggccgcaaggagccaagcgggagagagccgagcgtctccttgtcgtttccttaattcttcctgccgcttggcagagtgatccactaccgattactgatgaaagggcccgggatgggcagcgcgaaatcttgccgagaggcgcagctcgcatcaccagaccccgcacctcgccggccctccgtccgggtcgcctacccagcaaaaacggaagtg

SEQ ID NO: 129 - DNA, 207 bp, Homo sapiens
ggaaaccgaccagaccagcccatgaccaaaatatcacaggcagaccacccgcaaatgcagaggcctcagagtccacagtgggcagttggaaccaggccccagggaatctttcagctgcattccggctgtgatcggcgggcaacaggtagaggtgctggagggggatgagtcgtgattttcagtgtctgtcatattcgatcaagtgtg

SEQ ID NO: 130 - DNA, 136 bp, Homo sapiens
ttttatggtggtgtccgcagttttgttttaaaaattggtttaaatttatataaaactctgtacatgttcacaaattattgcataaacagcataatcttcaagacaagtgtttgcaaacacatgtccaattcaggaa

SEQ ID NO: 131 - DNA, 121 bp, Homo sapiens
gtaccatcactgaacgaagttccccttcattatttgaaacctaatagttttgtgaaatttcgttgcatgattcaggatatgtttgaccctgagttttacatgggagtttatgaaacggtta

SEQ ID NO: 132 - DNA, 158 bp, Homo sapiens
tgagcatgcaagtctaactaaaggcatttaaacacacgtttttaagaacactggggaggctgaatgaaacacatccaagggccaccactttgcaactcctgaaccaagcaaaaccaactggtgtcctgttgtatgcgtgtgttgtagagctttaaagc

SEQ ID NO: 133 - DNA, 31 bp, Homo sapiens
tcggttgtttacgcacgaaaccagccagccc

SEQ ID NO: 134 - DNA, 257 bp, Homo sapiens
ccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcc

SEQ ID NO: 135 - DNA, 405 bp, Homo sapiens
cccatctgttggttcctaggtcctccatctaagaaatcgttcttttggctgggcacagtggctcacgcctgtaatctcagcactttgggaggctgaggcagctggatcacttgaggtcaggagatcgagaccagcctggccaacatggtgactccctgtctccactaaaaatacaaaaattagccaggtgtggtggcatgcacctgtagtcccagctacttgggaggctgagacaggagaatcacttgaacccgggaggcagaggttgccgtgagccgagattgcgccactgcactccagactgggcaacaaagtgagactatctcaaaaaaaaaaaaagaaatctttctttcaccgagccctggtcatcatggtacgtatctcatgggtgtaaaggagtcatta

SEQ ID NO: 136 - DNA, 122 bp, Homo sapiens
cagaactgtctgtggaactccctcatcgatgggctcacagggaatgtcaaggagaagccaaggccaacaattgtccatgaccctcgacccccagaggagatcctagctgatgaattgccaca

SEQ ID NO: 137 - DNA, 252 bp, Homo sapiens
cactgcaacaagagtacccgatggcatgatggactgagagtctaaagagtgacattctgtaaaatggaagcagtgaatccaaaacagacagaaaaatgttctgaaaacgaaaaaggagagaaaagtaaaaccatatgacacatagacgacccagaaaacacaccaaaaaacttatgaaacacctcgatggacaaaggaaaagtttctgtcacatgacaacttaaaacgttttccacagataacgaatgggta

SEQ ID NO: 138 - DNA, 36 bp, Homo sapiens
tcttttccctaattgcgggcctcaccattgcatgca

SEQ ID NO: 139 - DNA, 168 bp, Homo sapiens
tgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttcca

SEQ ID NO: 140 - DNA, 78 bp, Homo sapiens
tgtgcctcgtgtctatcatcctgtaccgtgccatcatggccatcgtggtgtccaggtcgggcaacacccttctcgcag

SEQ ID NO: 141 - DNA, 661 bp, Homo sapiens
gagcaggcggctcagactcttccaacatcaactcctgttgctttgcctcctctccctcattctacaactatggcttcttgggatgctgcctatgtccagttgactgagggagaaaaacctccagcctggattatagatgggtctgtatgatgtgctggtaccacatgaaagagaacagctgcagtattcactcacactcactcaggggtgactgtgaagggcagtggtgaaggagaatccttccagtgagcagaaactcaaggctgtccactatgtctggagtgagagatggccagaatacagacctaaattgattcatggacagtcgctgatggtttagctggatggtcagggccttaaaaagaacaggactggaagattggtgacaagaaaatcttggaaagagatatgtggctgaatccctccgaatgggcagactgaagatatctgcatctcacctgaatgcccaccaaagggcatccactgcagagaagaccctgaatcagatggacagaattacatgctctgtggctgtcagccagcctctctatgcagctgctgtggtgtctgctcaacgggccgatgaacaaagagctcttggcagcagggacagaggatatgtatgggtccaacaacatggaattctccctccaaaggctga

SEQ ID NO: 142 - DNA, 92 bp, Homo sapiens
cgtgcctgctgcgcctgtgcccagcccggtggccccggccccagtgccatccagaagaaatccccctggcggcaagtccagcctcgtcttgg

SEQ ID NO: 143 - DNA, 77 bp, Homo sapiens
tacttcatcaattacgtcctcttcatattcatcaatttcttccccatcatactcatcttcgcttcccacatcacttc

SEQ ID NO: 144 - DNA, 51 bp, Homo sapiens
tacaggatttgatggggatcagtgccttggagttcaactgctagagctggg

SEQ ID NO: 145 - DNA, 184 bp, Homo sapiens
ggcgactgtcctaggagtatgaccaaccctccttcaatgctaggcttcagccacctcctcctgaaagctgtcctgtcatccccacccctaccccttatcaactccaggctagagtgggagacccttctttttgctccttctctgtagacccataaatgcccctgcatttggagacccataaatc

SEQ ID NO: 146 - DNA, 123 bp, Homo sapiens
gtacttacacatctttcacctaagattgccgcccttacagccatcctcagccttctaaggcaaggggggtttaaccgtttcatgtgccctggacaccctgggcagtctggtaaagccgctgac

SEQ ID NO: 147 - DNA, 41 bp, Homo sapiens
ggtcctgtagcatccacagtatcagcgttttctgtcctctc

SEQ ID NO: 148 - DNA, 63 bp, Homo sapiens
ttagctttaccagttgaaatccatcacacttcaaagcccaaatgctacgccttcaagctctga

SEQ ID NO: 149 - DNA, 141 bp, Homo sapiens
gtttgctcaattgtcggtacagataggtaggattccagtctggagaaacccctaaaccactacaccctgcctcagagtagggaagaattttcagtatgtatgtggagacaggctggattagggagccttttgagtggcttc

SEQ ID NO: 150 - DNA, 273 bp, Homo sapiens
cccgaacgcatcaggtgcagagaccggcacccaccgagagcggccgggagcgcacggcgagctccggtgtcaccgccggtcccgccgagagccgaggagggcccgcagcgctgcagaccctctggagcttccctccctcccctgcaaaaggggggtggggatcaagtccaatcaagaaaaagcccaccacgttttctcaaagagaaacaaaacgtaagcagtcccagtcctgctcccctccgcccccagatctactcgtcagctcctccgatt

SEQ ID NO: 151 - DNA, 85 bp, Homo sapiens
caagggggagagtgatgacttccatatggactttgactcagctgtggctcctcgggcaaaatctgtacgggcaaagaaacctata

SEQ ID NO: 152 - DNA, 700 bp, Homo sapiens
tgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttacc

SEQ ID NO: 153 - DNA, 49 bp, Homo sapiens
ggctaccagtgcagcatgcgagcgatgagcctgtacaccggggccgagc

SEQ ID NO: 154 - DNA, 92 bp, Homo sapiens
tgaaggccataagcagcacagatcacaaactttacctataattcgaggcaaaaatgcactttctaaccccaaactcttacagatgttagaca

SEQ ID NO: 155 - DNA, 191 bp, Homo sapiens
tgaaataattcatgccacggacctgtgcacatgcctggaattgagagacacagttaaaagactccaagttgctttctgccttttgaaaactcctgaaaaccatccctttggactctggaattctacacagctcaaccaagactttgcttgaatgtttacattttctgctcgctgtcctacatatcacaata

SEQ ID NO: 156 - DNA, 41 bp, Homo sapiens
tggactgcagtccttctcatccacgtctccttgtctatgac

SEQ ID NO: 157 - DNA, 210 bp, Homo sapiens
acgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaa

SEQ ID NO: 158 - DNA, 140 bp, Homo sapiens
tggccaatcactggtgtcaccgggcagctgtctagaggacttccgcgccacaccattcatcgaatgcaatggaggccgcggcacctgccactactacgccaacaagtacagcttctggctgaccaccattcccgagcaga

SEQ ID NO: 159 - DNA, 239 bp, Homo sapiens
gtagaacagacacaaccgcagatgctgctggatggaggctccaggcccctttggattcactcttcccccaccacagactggttcaggttgtccagaccaaggtgcataggggctggccagagtggtaggtggacaatgtcatctactggctgctaagaatgttatccctgtagtttggggctggtgtggctcagtaatcaaatgtgtgagcttctttgaagtaagatggccctgggttc

SEQ ID NO: 160 - DNA, 232 bp, Homo sapiens
atgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaa

SEQ ID NO: 161 - DNA, 90 bp, Homo sapiens
cacaaagacaacaggtggaactggcatagcatttacccttggtctgagagatggcctgggccactttgagaaaggagtagagctagaagc

SEQ ID NO: 162 - DNA, 488 bp, Homo sapiens
gctgtctctgcttcctaattaattcacttttttcaattatttagttatattactatggactcatggaaatttattttatctatgaggcataatccagtaagatcattagttattttgttgattaaactatttttttgtgatttttttgaacaacaaaaaatgtaaacaattgtaactgtatccagagcaaggagactggttgaggaataaaagcatttgaaagatagaaaagataaatatgactcagcaataagaagaaatgaaggactggcatgttatgacatggtggaccttgaaaacattatgttaagtgaaagaagttggaaaaaggaaaataggaagttataagacctgataagttacagttctggttcaggtttactactaactagttatttgttctgtgactttaaagtcctgattttgaccaggctgatgcaccctctaaaccacaatgagcacatctgtgctgggaagatgcatttatc

SEQ ID NO: 163 - DNA, 31 bp, Homo sapiens
tggaaacaagctgtggacaaactcttctctt

SEQ ID NO: 164 - DNA, 33 bp, Homo sapiens
ctcgtgaaagtgactgggatggtatcattgctt

SEQ ID NO: 165 - DNA, 33 bp, Homo sapiens
gtaaggatgttcaaacgctggagcatcactgtg

SEQ ID NO: 166 - DNA, 126 bp, Homo sapiens
gataaatattcaaaccttcgacctgttcacttttacatacctgaaaatgaatctccattggaacaaaagcttagaaaattaagacaagaaacacaagaatggaatcaacagttctgggcaaaccag

SEQ ID NO: 167 - DNA, 154 bp, Homo sapiens
cctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagca

SEQ ID NO: 168 - DNA, 792 bp, Homo sapiens
gagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagatta

SEQ ID NO: 169 - DNA, 29 bp, Homo sapiens
tgggagcaccaggatctcgggctcggaac

SEQ ID NO: 170 - DNA, 34 bp, Homo sapiens
aataaatctgtgaggtctcccatcaacctgaaag

SEQ ID NO: 171 - DNA, 100 bp, Homo sapiens
agatcttccggagtaatggggttcagctcttgcaacgtttactggacatgggagagactgacctcatgctggcggctctgcgtacgctggttggcatttg

SEQ ID NO: 172 - DNA, 138 bp, Homo sapiens
gttaacccttctcttgctgcggcagagtccgcacccgggcaggcccatctcagaattaacgctttgatggcatcaccgcgtcgggaatccctggggatggtgttctccaccgtcaagacctttgagccgcctgagcga

SEQ ID NO: 173 - DNA, 36 bp, Homo sapiens
tcctgtcccttgaccttaactctgatggttcttcac

SEQ ID NO: 174 - DNA, 83 bp, Homo sapiens
ccactcacatccgacgtgtgtggttgctcagtagggaaatgcttacagctgcctctagaagcaagtccgctcgctgcatggag

SEQ ID NO: 175 - DNA, 69 bp, Homo sapiens
ttgaatgtattggaacaggctactattaaacagtgtgtggtgggaccaaatcatgctgcctttcttctt

SEQ ID NO: 176 - DNA, 160 bp, Homo sapiens
tctctctatctgaagggcctcctgtactcttttcatttcctctttttccttaatcataatttgtatttcttcttgactttcttgaagtctgttggtcaactcgagcatcttactttctatactttgtagtgctgaatccttggctttgcgatgctccttg

SEQ ID NO: 177 - DNA, 101 bp, Homo sapiens
gccctgtgtaaccagcctgtcctcacacccaccagggaggaggagtcggcactggttaaccctctggtctaccaggcccggttcccaggttgcagcaggga

SEQ ID NO: 178 - DNA, 137 bp, Homo sapiens
cggtggctgtcgtgaaattgtgcttgtgtttcgtgatttctttgggggtgattgtctcgcttgttttcagttgtcgattatatgggagggttctgggtgggagtggggagggcgaggggcctagagctctaattgtt

SEQ ID NO: 179 - DNA, 41 bp, Homo sapiens
ctagaattaagatatgctgatgagttgcttctgcagttcat

SEQ ID NO: 180 - DNA, 49 bp, Homo sapiens
aggggcaggtaagtgagagtgtcagtgagcgggcgcagaggggactccc

SEQ ID NO: 181 - DNA, 144 bp, Homo sapiens
ggatcagtgatggacagggcccatttggctgccttcttggagtacccagggtagtcacgtttgtgccaggcctcttgaagtccagcaaccacagtgatagccttttggccacagctcttttctgtgttactgatgtctctcatc

SEQ ID NO: 182 - DNA, 31 bp, Homo sapiens
tcacggaggacacaaactcaccactgttcct

SEQ ID NO: 183 - DNA, 33 bp, Homo sapiens
gatttcatcatggatgcctcaattgaggagaaa

SEQ ID NO: 184 - DNA, 108 bp, Homo sapiens
acacatgtgcgtgtggccttcttgcccctgtttgcctggaggggtaatattataaatattccttctatggtcttctctctcccctgcaaccctaggaaggttttcctg

SEQ ID NO: 185 - DNA, 698 bp, Homo sapiens
agagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcct

SEQ ID NO: 186 - DNA, 437 bp, Homo sapiens
tctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatga

SEQ ID NO: 187 - DNA, 90 bp, Homo sapiens
acatgttgaccggtctggttttgaactcgcctggcctgccttcccatatcttaaggcccttccttgctcacatctgtttcaatggaatga

SEQ ID NO: 188 - DNA, 128 bp, Homo sapiens
ggagacgaaaacaaagcagtgaggctggaggagacaaaggggggtctgggtgagggcccgagcagagggtctcagcagggacagcgtgctgggagctgccggccccacacagggggtgccgcggccct

SEQ ID NO: 189 - DNA, 431 bp, Homo sapiens
cccggcaagactgatttggaatggcaggcactcacagttgtgtttatttgagggtaccacaggaagtgggggcccccaaattggctaaggagccccagggtggagggaggtagaagcacactgggtctgtctgggagcctgagcaccttctctgtgggctccttcctacccatggattccaacccccacccacctccccactgcccacccactcacccatctcttctgctttccttctccctgtgccccaggccacaccattcctctgtgcaccctgcactttcccctctacacctttgtccttgacacctcctctgccctttatcttcctcctcctcctcctcacagcctttccccctccccatcaggattctggctgcccttgctctgcaaccctgcctggaacttcaggtccctgatcttacagccta

SEQ ID NO: 190 - DNA, 80 bp, Homo sapiens
cacagccgagccagtggagccgttctgggcaggtgtaaggccgtggtgtctcaggggacatcccgtgtcacagcccggag

SEQ ID NO: 191 - DNA, 229 bp, Homo sapiens
tctgcaccaggaatgagacacactacactagtttgctaatttgtttcctagggctggcatgacaaagtaccatcatcatggtggcttcatcaacagaaatatgttattacctcacagttctggaggtaagaagtccaaaatcaagcaatctacagagttggtgcttctaaggggtatgagagaacaatttatttcaggcccatctccctctatgtgagtctgtcttcaa

SEQ ID NO: 192 - DNA, 46 bp, Homo sapiens
tctgttcttatccggccactgccttccataatagcctaagaagtgg

SEQ ID NO: 193 - DNA, 31 bp, Homo sapiens
gcataatcaccagcaacacccgggacaataa

SEQ ID NO: 194 - DNA, 75 bp, Homo sapiens
catgtatcaaggggagcctggactcctgaggcactgtcatgatcacatctcccttaccaacctgaattggacatt

SEQ ID NO: 195 - DNA, 232 bp, Homo sapiens
catctgcatgggaactccacgcggagacaaggtgggcagaggcgggagcagccgtgggggatgatggggtctgatccatgacggacggccagcctttcttctgcaccaagactctggcagccctcgctgggcagccaagtttgccgcaacctgccttttcacagacagctctttgtgtgtaataaaatccaggcaagtggtgggtggcagaccgcaggggagtagctgaatt

SEQ ID NO: 196 - DNA, 119 bp, Homo sapiens
gcacaagactctggccttgatcaaggatgggcgggtcatcggtggcatctgcttccgcatgtttcccacccagggcttcacggagattgtcttctgtgctgtcacctcgaatgagcagg

SEQ ID NO: 197 - DNA, 44 bp, Homo sapiens
ctctgactgtcctgaacgctgtcgttctgtctgtttcctccatg

SEQ ID NO: 198 - DNA, 80 bp, Homo sapiens
agctgattgatgagaagctcgaagatatggaggcccaactgcaggcagcagggccagatggcatccaggtgtctggctac

SEQ ID NO: 199 - DNA, 52 bp, Homo sapiens
gagaagggtaaaagtcttcatgctctcccactctccaatgatgctcatgaaa

SEQ ID NO: 200 - DNA, 138 bp, Homo sapiens
agcagttcagcatgggactagtaccaagactcacactaaggaagaaggagttggaataaattgaaagaacactctggggttgtgcattccccattgcagaattggggacactgctgtaaatggggagtactcactgga

SEQ ID NO: 201 - DNA, 97 bp, Homo sapiens
tgcagggcacactctgtctggctgggctctcctccgtaccatgacacgtctctccgttggagtcctatgtacaccaccatggagtcggcgcctcatg

SEQ ID NO: 202 - DNA, 70 bp, Homo sapiens
agactcctcttgcaaggcgtacctccaaacataattgattcgtatctgcgagacttacactcaagcaatc

SEQ ID NO: 203 - DNA, 156 bp, Homo sapiens
tgggccttttcgttgttcttcagtgtgggccacgttcactttcagacagtaactctgtagggataactctgtcagtggtacgttcagtccttcatctcacgcttcttcatctcactcttctcgagaatgctggagtcattggtatcctcagttcca

SEQ ID NO: 204 - DNA, 63 bp, Homo sapiens
actagagatctggtagttcgtctcccaaggctgctaactggaagtctggaacccgtgaaagaa

SEQ ID NO: 205 - DNA, 47 bp, Homo sapiens
aaacagccttcttcacgcttcggctcccctatcgattcaaacgtaaa

SEQ ID NO: 206 - DNA, 97 bp, Homo sapiens
tctgtcagccgacttcgggggagctgtgttcaggagagaagggcttgggaaagctgtgctctattccatgctggataaaaggagcagagataacccg

SEQ ID NO: 207 - DNA, 63 bp, Homo sapiens
tgagcccatcagtcaagcctatagcctggccctctacatgcagaagaacacctcagcgctgct

SEQ ID NO: 208 - DNA, 63 bp, Homo sapiens
tgaacgagtttgagtacctgaagctgctgggcaagggcactttcggcaaggtgatcctggtga

SEQ ID NO: 209 - DNA, 367 bp, Homo sapiens
gtgaagcctgggagacctcctgacatggggcccacctgcaccagcacacccccaccccacccccagtacctcaacaccctcaaaccttcctggggaggcagggcctggtgccataccccccagcccaactctgatggggctccagccacccaatggacagggcatacagacaggatagtggaggcgttgagacctgcttgatttattccaagtatttaatacacaatgacgcaactgtgatcccaagtgtgcaaagttaaagccttcgactgcagctgaggagaagggaggaatggttcacctggggacggtggtgagtcaggaatgacaggcaggcggccatgaccagggcagtctcctacccatg

SEQ ID NO: 210 - DNA, 387 bp, Homo sapiens
ccctccgacagttccaattgattgaaaaaagcctaatttaaagttctgtttgttctatgtcttaaaccatcagaattctcttttgggacctgaggaatgctctggaggaaaaagaatccaaggataaaaagtcattgcaagccaacaattgttcctaatcctcacaaaatgctggagaaattaaatttattctttattgctcaaagtgttacctaggtcactgggcgatgggaaaattggactggaagtcgagtaggcgcaagctttgttttgtgtctagatgcttaaccttagacacgacaaggcatcttagagtgttgtgggaacttggttcagagcattaacaccaagacttttattaccccggatttataataggctgtgctg

SEQ ID NO: 211 - DNA, 252 bp, Homo sapiens
acatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttgg

SEQ ID NO: 212 - DNA, 199 bp, Homo sapiens
tccctaagcccttgctactttatgggttagctttgcaggtttggtggcttgaggggtgggggcaactcaccactgccaggtaactccctgaagggtgggagtggattatcttctaggctcttacccgcggtagggaagggcatcaacactgtcttccttccattctcctttcccccatcccatttagtgctgccacagg

SEQ ID NO: 213 - DNA, 145 bp, Homo sapiens
ctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtattta

SEQ ID NO: 214 - DNA, 69 bp, Homo sapiens
gagcagctggcgcaacaaggcaagatcaaagagaagatgtacggcaagcagaagatctattttgcggat

SEQ ID NO: 215 - DNA, 101 bp, Homo sapiens
caggccaacgcagccatctgattcaggttgggttgcccagggaacagactctgagatggagattggcgaatagaaggcttattacagagcacactgggatc

SEQ ID NO: 216 - DNA, 127 bp, Homo sapiens
cccagagactacagagaacgtggtgtgtgccctgggcctgactgtgggtctggtgggcatcattattgggaccatcttcatcatcaagggattgcgcaaaagcaatgcagcagaacgcagggggcct

SEQ ID NO: 217 - DNA, 309 bp, Homo sapiens
tggctttgtctctagccgggccatgctttccttttcttccttctttctcttccctccttcccttctctccttccctctttccccacctcttccttccgctcctttacctaccaccttccctctttctacattctcatctactcattgtctcagtgctggtggagttgacatttgacagtgtgggaggcctcgtaccagccaggatcccaagcgtcccgtcccttggaaagttcagccagaatcttcgtcctgcccccgacagcccagcctagcccacttgtcatccataaagcaagctcaaccttggcg

SEQ ID NO: 218 - DNA, 87 bp, Homo sapiens
cagagaggtggtaactcccgagtaagcaatgccaatccttcaggcaaagataaggaagaaccgcacagctgctccaacataaagtgg

SEQ ID NO: 219 - DNA, 269 bp, Homo sapiens
cctgctagtggcacatccatcagtacatgaactgaatatgtcacagagtgtatcaaagctaaggtaggtgcctgtcccaccatcagttgaatgagaaggtttctgatatcagaaattgggctaccctgctttgccaagactctcttttccaatctctcaaaggcagataataacactaatggacaatgtggccatgagcattaaaacaaatcattaggctggaggcttctcatcagtgcttgagggcaatttcaccacctggggctttc

SEQ ID NO: 220 - DNA, 176 bp, Homo sapiens
ttgcaaaaaactgccgagatcaatacaaattccttccaatgctggccaaagtagaagacctgtcacccaaattaattaacctttcctcaagatcaattggttttctgttgatttagcagtaatattgtagaacatttagctataatgtattttaatgtgatccctcaatgtcaaca

SEQ ID NO: 221 - DNA, 95 bp, Homo sapiens
tgggaagtttagaccaggaaattgcagctgtattcacatgctatcatgcttcgggtacagagaggccctctatgccccatgagttcagaaaccta

SEQ ID NO: 222 - DNA, 54 bp, Homo sapiens
gaaaccagacttctccgacttcttcagtgtggttggagatggcattcctggcaa

SEQ ID NO: 223 - DNA, 100 bp, Homo sapiens
ctcttgcaaaagaggctccacattttccaggctttgatgagaacttcgacataaacgtcaaacacagttcctgcatccgaaccgattctgaggccttgta

SEQ ID NO: 224 - DNA, 112 bp, Homo sapiens
tgtctgggtatctgcatcacgccgagcctcctgctttagttggtggaatttgtgctgcgtccagccatatactccacagttgagtagaccctgagatgttgccgttagagcc

SEQ ID NO: 225 - DNA, 31 bp, Homo sapiens
gtccggggcactgctccggtttggaccctga

SEQ ID NO: 226 - DNA, 2180 bp, Homo sapiens
cggggaatcctcagacgtctccattcagaatctcccaaacgattgttctcttttttgcattcttctccttctggcttttctgtgtggggttagtaaccagcacagggttgggggcagaatgggcagctgaagtggtcgggctgtgcggacgtgtgggagatagctgggtagtgttgctgggtgtggcagttggcagagcatttgggcctcccacagtaatagaaactctctttggctccagcatccagcaggaggttctgggtttaacccctcggtaatcctgggagccttcctggtgcctggggattctctcccctgtgtagtctcagtggatggcctgtcttaactctagatacattttgccttgagggggcttagtctaggttggtggtctggagtttggactgggctgagcagtgagctttgggactctccctaattttggggtttctttgaatgagccactttcttcctctaggccttcattacctttgccttaaaaaacaaaatccctggtccagtaagccattgcaaagcatctctaggaagttgacaaagaaatgcttttcttctgcctcacttgctgccgatcacagtaatagcaatggtgattaaaaatgaaaaatgatgacggcctgcagaatcagggaggtcagtggcatcattgatacaattcacaaagcagactctcggtgcccacacatcactaggaagtctctctcctatcgagtagatgactacagcattcttggccagtaaagccagttggaattagccaacagcagattggtctgggctctaaagataaaaggaattatgttgggtaattttcggaggtacctatgggatcctacctctggccacacagtggtcgcctctctctgctcatatgtttcggtgggggtggggggttcctcttccccatgctgctcccgttgctatccagggaagattggccaattctgcttcctgttatttcttcttctcctctgtccatttgaggtgagtctctaggttggctgtgaacagcctgaggaacccagggctgtttggaagaatctgatgtctcttccttcaaggaccctgacaggtctcagccctccagcagtactgcagtgagggatggcagggggtgttggagtggagagatatcgacttgggtgcagctggggagactaaaaggagtgagccaagtccctcaagaagtgttggctagagtctggccagccctggctgtagggctggagccagacgtagctgctggctgtgcttgggagtctcagccctcatatgtgcagtgtgtccctgggcatggctcttcgtgatccccactcccacgaatagccctgtccttggttagattgggaaaaccagggtgggaagtaaaggggaggttggttttgctcgtggtcatgcagttatctctctggcctctgatgtttccagaattgggattggtgcttccctgctgattttcctatttttgtccctcatctggttcttttcctccttgctcaccagcctgggttctacacacatgacatggggcattgtgtgttcccaatgaggatagcagaacagttggtatctcctgagagaggggccagcatatctggcacttttttcttgacctttgaatttctgaggtctgggagtcaggaggcagcatggggcctctccatccgggatccagcagaggttaacagagttggtggctctggagctgaggtggtgtggcttggctgggagttgtgggggagaggccctgccaggggccctgattggtcagtaccttctctattccattgaatcctggtccggtcagctctgtgaattgtttaatgcatatcttggctctgtcccctggctcgagtgtccctaaggctgcagccacagctttagagaggatctgtaccttgtgctggtcactttttttgggcgtgttacctccctctgagatatgtaagagataccaccctttcccaccagccggctgtctgtgggaggccctcattttgctttgcttttctgagacttggagtgactgtgaggaaagcatggactgagtttgctttcttgctggttccttccacaagagctgctcatgggctgataaagccagagaacacctccagggccccatggcctgtgcggagcctggtaccatagtgtcaagccta

SEQ ID NO: 227 - DNA, 183 bp, Homo sapiens
gccagagctcagtaacatccacatcccagagtacagagagaaagccagcctgggtcacagtagtcagcgtctccagggccaggctgccaggagagtgggctccctgcagaccaaggtttcaggatgagcaagcaaggtgaaaacaccaacttgccacacgcaaatggctcgacacaaccctta

SEQ ID NO: 228 - DNA, 70 bp, Homo sapiens
ttagcatttctgtgcagacagcttttttgctgttcttggtcctcagcaatgacaatggctccgaggagat

SEQ ID NO: 229 - DNA, 112 bp, Homo sapiens
ttccggattcgcttatggtctccagggtcaaaggaaagggcgaaccaacgtttgaaggcagcagcagcttttttccagttgcccaaatggttactcaaaatgcaaggggaca

SEQ ID NO: 230 - DNA, 1056 bp, Homo sapiens
agtgagtcggcctcttgaactgctcaggaaacatccccagatggagagagagaaacaggcagtgggtgagaccagagctcccacctgaacacagtccccagcacagcatttttgactgcaccccgagtcccaccagggcccctgtaccacttctacagcccacaggatcaggcccactcatctctactaggcaaagattccagggcaggcccagctggaaggaggcggcacccccagcccagtgtaatcaagtcaacagccagaccaaaacctgtgatcagccaacaaagtgcgcactcaaaagttctgggccaccaaaccatactgagcctgaacaggggcagggagaatgtctgagaggatatggccattgaagacggggaagaaagaacaaaggctgcatcttctggaagagaccacaaccagggcaagcactccagggagcctacgagggggctctgcggggatgagcccatgggaggctggggtgtaggagtgctcagaacaacaactctgggacacaagaagctacaggcaccaacagtgaggtctcagaagggtcccagctggtggcctccaaattctccatactgcagaaccccaatctgctcaaaatccttgaatggtttctgattgctcttaagctgaagaccaacattctctcccttcccctaggtctaaaataaacacatactccccacctctggggcaccaagagttgcagccacaccaggctggtctgttgcctcacatgcactgcactccctcttgccacagggcccttgctcctgctgcctgcactgccctccccctcgcccccctcagtgatcaactcccactcatcctgcagatttcagcttggatgtcacctcccgagggacgctgtgcctgcctccctcgtcagagcaggtgttgtcatctactcacagaatttggcttccttccacaaagcaaccccgtgaccatctgtttaacattgtctctccacctagactgtaaggtccgtgaaagcagggaccacacccatttgtgctcacttgggacctacagcctcta

SEQ ID NO: 231 - DNA, 72 bp, Homo sapiens
gaccccactcttcctagtggacagaggtcgagatccccactgctgaagtttgtcgagcagcccactgagaac

SEQ ID NO: 232 - DNA, 357 bp, Homo sapiens
catcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtatt

SEQ ID NO: 233 - DNA, 82 bp, Homo sapiens
aaggacctctttgatttggtgtgccggactctggggctccgagaaacctggttctttggactgcagtacacaatcaaggaca

SEQ ID NO: 234 - DNA, 107 bp, Homo sapiens
gatataagccaagctaagaagaacaaggactctgtgaaaggaaagtcacctgtttctctggcccaagtgttcgcctgtcaatctgctgttccagatccagactataa

SEQ ID NO: 235 - DNA, 167 bp, Homo sapiens
aattttatggttcgggtcacagtaggaagcggacaatgaggcgggagggcagagagaaccgcaacacctggtgccgggtcgggtcgtttccggggctttcagtggccggaagtcgcggcgcctgtactgactctaggaagggctggagttgttttgaatgggcgccc

SEQ ID NO: 236 - DNA, 27 bp, Homo sapiens
cctcatctctggggatctcaacctctc

SEQ ID NO: 237 - DNA, 832 bp, Homo sapiens
gactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctg

SEQ ID NO: 238 - DNA, 201 bp, Homo sapiens
agccgccgcttcacatcggggtccccgcccccccggccggggggtggttgccgagcttggttggggccccggttcatacactccggggcaagatgctacggccccgggcgggtggccgagtcggcggcaaggcgagggacccggccggctccgctcggcgccgcccccgctcccggctcccgcatgtgtcgctgcggctgg

SEQ ID NO: 239 - DNA, 92 bp, Homo sapiens
gtagagctggggttgtcagaggctagggcagtgactgaggacctgggcaaaacctgccacagggtgtgggaacgaggaggctccaaaatgca

SEQ ID NO: 240 - DNA, 423 bp, Homo sapiens
cttgcttcaggcttgtgaattcctagacacaaccctacccaaagacttccttcaccaacatatttttctttctagataataggcacaaaaaccatttagaagtttgagatggaaatcatgcaatgcactctgctctttatatatgttactgaggaatctggaagcttttccgggttgaaatgcaattcctaggaaattattcttgctcttttcctgtggctgtttttaacacagcagcaatgcaatttcagtggctctgctccttcacaaagacctttgagagggaactatgctgagagatgcaaattcaaggttttctgaaaacacctcagaattgtccagttctgcccccagataaaaccactagaataaaggtcaggaaatctccagatgttcttgggacttgcgcagtcatctcaggta

SEQ ID NO: 241 - DNA, 108 bp, Homo sapiens
gaaatccctggcctccatataagaaaaggacatcactccatcctagctataaaggtcttatgagacttttgcactgtaaaactttacacattgtgctattcactctgc

SEQ ID NO: 242 - DNA, 179 bp, Homo sapiens
cagatgccagccttgatcctgatgagctatgcactctaatgtggggccactcaccagtcagccaatcttttattgttcctttgctactttgaaaggaaaaaaaaggttgtctcttgatttctgtaattcttctgctgatctgtgagtagggcactgccctgctcccaatcaaacttagt

SEQ ID NO: 243 - DNA, 228 bp, Homo sapiens
ttagaactcatactgccacatcttgattcctgcacaatctcttattagttgtgatttttaacatctttgtggttgttttcacatttttaaagtgaagagatagcacgttcattgtagagatttggggattagcaataacacagtcaggtctctagcacatactatgtattcaatgattggtggctaatatttttccttcacaaaatttgggcctactccactggactc

SEQ ID NO: 244 - DNA, 50 bp, Homo sapiens
acagctgttgagtgaagtgaatgaatggataccagagagggcctcactgc

SEQ ID NO: 245 - DNA, 290 bp, Homo sapiens
aggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcagccgccggagccagagagctgccggcaggaggcggcggcggcaagaacttgaacttg

SEQ ID NO: 246 - DNA, 31 bp, Homo sapiens
aaatggcaaaagaatcacataaggcagaaat

SEQ ID NO: 247 - DNA, 782 bp, Homo sapiens
ccctctgactgaacaggcgtctgtgacctggcctcacgacctgggacatgccatcctcaggccacagacactggactttggtcaagtactagcctccaggtggggtcctggtgcaagcagacagcaacccccgagccgtgactgcggttctcagtttggagtttggtcaaacaaccaatggggacagagtcttggggtcaggtccagcaggaactgccacccctcccagggacagcctgtctctcccactcaccatcgctggtgcccacgggctgctgaccacctgccaagtcctcctgtccctggaccagcctctcaggcagcaggtcttacctttgcctccagggcactgatcgatggcagctttgtctcactgtaaggcaacccagacagagctgagggcctgtgctgggccgggagctgtcctcctccttccctagcagtcctagggaaggaccagccgtgtctctccccaccccacccctggtcttagcccaggagacacacagggaaggtaggaagagggtctccctgtgggctgacgcctgtgaagggacaggacctgggagaagaggggtgtgtgggtggggcagggaccactagggccctgtagagcatgggcttgggctacacaacagggctgcccctcctgggctagaggcagtgccctctgcaggagctgagaaagtccagtcctgagaaaggacgtgtatggcccagggtgggtgactgggccccaaaagcagtcctcgagggagtgaccacattaccaggccaggatc

SEQ ID NO: 248 - DNA, 97 bp, Homo sapiens
tgatttctgataatttgtgacaacctggagctgtgatatagggctcaatatatttaagatttagaatttaaacacaggcaagcattaagtatgttta

SEQ ID NO: 249 - DNA, 100 bp, Homo sapiens
ccctggctctaacaggtttgggagccagttacctttcccagttcattaaccgactggccttcgcattaacagcccctccatcgggggttgccttggagac

SEQ ID NO: 250 - DNA, 106 bp, Homo sapiens
agaggctccgtgtgacttccgtccagggagcatgtgggcctgcaactttctccattcccagctgggccccattcctggatttaagatggtggctatccctgaggag

SEQ ID NO: 251 - DNA, 69 bp, Homo sapiens
cggtctctgccttgctcgtgcttctaccaccacccttcccctcccaacccggtggatcctctcgtctcc

SEQ ID NO: 252 - DNA, 113 bp, Homo sapiens
agtgggtaggagtcactcccatcaatgaagaaatatcctagaaagggccaggtcaggtaatcacctggcctcggggaagtaaactgcccccatgagactaagggatcacttgc

SEQ ID NO: 253 - DNA, 301 bp, Homo sapiens
acgtgtcaccggactgacttctagggccagtcacagaaagccatgcagttcctgtcttgttggaaggaacactgctcttcaagccctgagctccgcttcgtaagtccaactcccctaaggccatcatggcaggagaggccatatctgggcgcttcagtggatgttcttatctggacccagccttccagctatccccactgacatgcaaaccaagcctctagaccagcccgtccaccggccgaatgctgcctgtgaccgacctctgccattgccacatggaacagaagcacctcccagctgc

SEQ ID NO: 254 - DNA, 155 bp, Homo sapiens
tcattgcggcgtgaacaataatttgactagaagttgattcgggtgtttccggaaggggccgagtcaatccgccgagttggggcacggaaaacaaaaagggaaggctactaagatttttctggcgggggttatcattggcgtaactgcagggacca

SEQ ID NO: 255 - DNA, 28 bp, Homo sapiens
tgttgttgcaatgttagtgatgttttaa

SEQ ID NO: 256 - DNA, 281 bp, Homo sapiens
catctcttttaaggtggaccagttcccgtggtttgttttgtttgtttagactttttagagtctaagccagttgtcctgaagaggatgcaattgttctatcaattttggggtgtcagacttcagtttctccagaactgttaggaaattaagttgttaatgtgttactgagtttgatcagggctgaagaagcacagccaacctttgagagcttattgcttgaaatgatggcatccttggaccttttcatggcatgttccttctgaagtctctaggtctgggcc

SEQ ID NO: 257 - DNA, 214 bp, Homo sapiens
accgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacc

SEQ ID NO: 258 - DNA, 270 bp, Homo sapiens
ctccttctatcccaatcggacagtgatatgaccctggggatgttccatgaatcatttgttcctctttggccccatctgattgtgtacttatctccttacacagtccttctgaccttgaaatgatccagaaaagatgtaaaagagtaaattctatagtcagtttaaaaggcagcaggaaaggattgggaagcattttggacaaggggtctaggagacaggcccagctctgcacttttccgtgggacaaaggcctttgcattctctcctgta

SEQ ID NO: 259 - DNA, 33 bp, Homo sapiens
cagtgagttggtgatcagctcggccaccttgga

SEQ ID NO: 260 - DNA, 129 bp, Homo sapiens
ggccaagcctaagtccgtccctctccgcccacgggcttctccgaggccatctccgaaacgccctgcagctgctggcagagcccgcatgggcccctatgtggcccctggacagaccgacggcactcctgg

SEQ ID NO: 261 - DNA, 33 bp, Homo sapiens
gaggaatgtgccctggagatcatcaaaggggga

SEQ ID NO: 262 - DNA, 90 bp, Homo sapiens
accagcatctcgagccctgccctttccacccaggacaccaaatgggatgctggatcagttgctgagacaatggccaaagggtcagctgga

SEQ ID NO: 263 - DNA, 80 bp, Homo sapiens
tgtgggaaccccaagtacaccagaggcacttctccacaaagaagcttctatcaatgggaagcctagtgtgtcacggacca

SEQ ID NO: 264 - DNA, 73 bp, Homo sapiens
aagacgcacacagccactgtagttgagttaaacccatgggtggaatatgaatttcgggttgtagccagtaaca

SEQ ID NO: 265 - DNA, 90 bp, Homo sapiens
cggatgttttttcgttcctgctgtatccgtcctctgaacctcggggatctgacagtcgaacagaggcttcccagcaattctgtgcccagg

SEQ ID NO: 266 - DNA, 203 bp, Homo sapiens
aggctctctgaacatacaaacagtataactgttgttcactaaatggaaaaatcccaaaatcaaaaaccaatgcaaaacagtgaagtggcttgagctcctaggaggttaggtagaaattaaagagaatcagtggatgggtagaattttaagcagtaggtagttacccaatgtagaacgaggattagcttagacacctagtctgg

SEQ ID NO: 267 - DNA, 111 bp, Homo sapiens
cctgagccaccagttatcaccagtaacaggggatgacacacctacctcctggggctgttgtgagaattaagaaacactaagtaaggaaagcacactctcaggtatgcggca

SEQ ID NO: 268 - DNA, 614 bp, Homo sapiens
tctgctaaaaggatgaagcccaatgaaggaatacttgagaagtgatgtgatacaaggacatttatacaggttttggcatgccatcccaaatactaagtgcttttgtttacagctgtaacttgttctgaaactaaccatccccactttcttttccaaagattttggtttttgagcagtaaagaaattgttatccattaactgaaaaaataatcacagccaaacatcccttcccacatgactgtatcacagaatagtttcaaatgaacaactatcttttcagacagttatctaccaactctccgatgtcttttctactctgtgaagatggcttgcttcatcgcttcacttgtcattcctcttctggtcctaaagctcatggtgaggttgtttgttttattttagggttaaaaatcactatacccactataaggagggtgtaccagggtgagaagagtgccatgcaggcacagctctaaaggaaggggctgcttcatcttccacatgtctaatgaagagagcccttttacccctttaacataggcaaatgtatagaaacagacccctgaaacttctgaatctgccatcctatagctttagcttgagagcccatttcc

SEQ ID NO: 269 - DNA, 829 bp, Homo sapiens
gagagactgagtgccacccatgagaactggtggctcctctgggagggaacctggatacagtgaggagaaaagagcactgtgaattagagccagatgcttaagtccaggtgagacaggttatgccatcttccaaagtgtctaattgcctcaggcgtgaaaccaattcctatttacttagcccagctccatggggtactgagatacatggggccgaaaaggggtaatatggccatcttttatcagaaaaagtgacaaaacgggaatttaaaaaatgaattttccatctgactttatttccaaatacactttcttttttaaaaaaccaatacactttctttgaggatgacagtattaggaaatccaattatacaaaaaatactacatctagtctggggtagatatatttatttttggtaacatacattaagtggcactaattacacagtaactataaggtaactaacatgaaaccacagaactgtaactctgccacagctgcatgaacttgggcttttctggttgagcccattttcaaaaaactgcccaccccagagctatgccaacaaaatctgttacggagtaaagccctgaagtggtgactcaccagagtaccttgcagctgacagataataggcaggacatgttagttataaagtagttacagcctaattcacaaaagttaccaactgtttctctttctagaaagaagcaagaagttaagaaattccttgaattagcgcctggtgtgtcaggtgggagtgcagaggagggctgttagagcagtgtcaaaaggaccctggtgggccagacgggttggacatcgttaata

SEQ ID NO: 270 - DNA, 62 bp, Homo sapiens
tgtggctatacccaggacctgacagacaactttgactggacgcggcagaatgccctcaccca

SEQ ID NO: 271 - DNA, 80 bp, Homo sapiens
ctgctcccggtcttgggccctgggaaccccaccccaccccaccccacaggcgttgtaaccttgaatctgcccagactctt

SEQ ID NO: 272 - DNA, 1014 bp, Homo sapiens
ttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtt

SEQ ID NO: 273 - DNA, 32 bp, Homo sapiens
agagaaggaggccggaactacaccagcaaaag

SEQ ID NO: 274 - DNA, 67 bp, Homo sapiens
gatgccgctggacttcctggcagaagcatggagggtcgctggcactctaggtccagctatgcccatg

SEQ ID NO: 275 - DNA, 182 bp, Homo sapiens
ggtgcagcaaatccgttttctccttttacattggagccctggggttagatgcagacgagtagtgttttcccacgccaggcaggcaccgactgcaagacagacactgggtagaacccagaagaatgtaatggaaccagatcattcctggtttccccaagtccgagacatggttgcagctagca

SEQ ID NO: 276 - DNA, 45 bp, Homo sapiens
ctctgcaagaattgctgcagacctcgaatacacctcctgctgctg

SEQ ID NO: 277 - DNA, 88 bp, Homo sapiens
cgaaccccatcacgggtgaggacgagccctacttccctgagaggagccgcgcgcgccgcatgctggccggctctgtggtgatcgtggt

SEQ ID NO: 278 - DNA, 175 bp, Homo sapiens
gaggactggctgaccctttcttatacatgaggaagtatgagtaggactggggcgggggcttgaggctgttagaagtcaggggaagttcctaactgagaagctgcacagaagtgatggaagtctcatttggtagactcagatctattgggagatttggtcctgtattagtcccttc

SEQ ID NO: 279 - DNA, 28 bp, Homo sapiens
tgtatcacatcaatcacgggaacccctt

SEQ ID NO: 280 - DNA, 77 bp, Homo sapiens
tacaaacctccagggaacctggctggctagaagggactctgaacggcaagagggggctgattccacagaactacgtc

SEQ ID NO: 281 - DNA, 91 bp, Homo sapiens
cacccccaccgttgacagaggaaggcagggggtgagaattaactgcttgagggtaggagagtctgagatgtgggggccctattccgctccc

SEQ ID NO: 282 - DNA, 41 bp, Homo sapiens
agatgtcagcaattaggcagatcaaggtttagtttaacttc

SEQ ID NO: 283 - DNA, 87 bp, Homo sapiens
tgggacttgctgtacaagctgcgtttcgtgctgacctacatcgcgccctggcagatcacctggggctcggctttccacgcttttgcc

SEQ ID NO: 284 - DNA, 30 bp, Homo sapiens
ttgcagattcattcaactttaatccccaca

SEQ ID NO: 285 - DNA, 223 bp, Homo sapiens
tggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcgga

SEQ ID NO: 286 - DNA, 418 bp, Homo sapiens
caacaggtttctcagctgcagggcttctcagagcctgcaagggctccaagtcaggtgggagggtggcccttccccacaggcagtcatttggcagagccttccgtgaaaccagcactctagcctggctgctccaaacgtggtcatgcaccagcagcgtggtcatgcaccagcagtgtcacattccctgggaactcccagaaatgcagaatctgggatccacccagacctgcctcaggatctgcatcttaagatccaggtggggcagagaccatctgagttcaccaagcatgctgtgtggcacccagaagggacctctaaatgcctttcagcaagcacagactctgggccagacagcctggcctccatttctggctctgctgtgtgaacttgggctaactcggggagtagctctaccttc

SEQ ID NO: 287 - DNA, 231 bp, Homo sapiens
ttttgaaggttatccgaggtcaccatctgcatcttgccaaagccaggacaggaagatgcattcttgcctggttctttcttccccttcagcctttcccaacacacacccattaattatccttcattgtcccacagtaatttctcagggatctagtcccatctctttattcctttactcgttccctgggatataattacagcctgataaccaggctatgactacggacttatc

SEQ ID NO: 288 - DNA, 103 bp, Homo sapiens
tacacggagcggattgcaaagcaaaccaacaagaataaaggcagctgttgtctcttctccttatgggtagggctctgacaaagcttcccgattaactgaaata

SEQ ID NO: 289 - DNA, 341 bp, Homo sapiens
gacatacacacaacacgcaggcgggcagggtccataaattacagtgagagtaggggaggggcaggagagaaagaaagcaggtggggtccaagcacaccccagggataacattccagcctgcatcaaggtggccctgctgtgagcaccccccagtctgtgctggggctcctgcccaccctctgctccaaccagcctgaggatgaggcacagggaggcagggcccatcactcaggaggccatgggagaaacagtctccgggaggtgctgcacctggggacccagaaaagtaggactttttctcctaggacccgcatcgaggcaggggacctcattcctagtgc

SEQ ID NO: 290 - DNA, 102 bp, Homo sapiens
gttaagggcagcctcggatcacagaggttccatttccgattttccagaagttgccgattattaatgatcattgttctttccttctggggcataacaaagcag

SEQ ID NO: 291 - DNA, 249 bp, Homo sapiens
ccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttct

SEQ ID NO: 292 - DNA, 380 bp, Homo sapiens
tgggactcacatgaggcctattacccctttcttctggcctattcctcccttttggaatgggaatgtctgcaccaccactgtatcttggaagtaaataacttctttttttattttacaggttcacagttgtaaggaacttgccttgagtctcaaatgagactttagacttttgagttgatgctggaacaagttaagactttgggggatggaataattgtattttgcaatgcaagaaagacatgagatttgtttttcatgccaccaaatcttatgttgaaatttgatgcccaatattggaggtggggccagatgggagaaatttgggaacagatcccccatgaatggcttggtgacattctcccaggagtaaataagttctc

SEQ ID NO: 293 - DNA, 98 bp, Homo sapiens
tggctcttggtctggccactcactatttgtgagatcctggcaggagtgaaacttcagtttccggagccttcactctatccttctcctgtccgcatctc

SEQ ID NO: 294 - DNA, 30 bp, Homo sapiens
gagggcgctgcagaacaaccttggagctat

SEQ ID NO: 295 - DNA, 59 bp, Homo sapiens
tcctggaaatgccattgcccccctggggcctgaccctcgctggcaatcctccacttccc

SEQ ID NO: 296 - DNA, 88 bp, Homo sapiens
tggtttttaagtactgtggacagaatgacctctctttctgtcccaggggccactctagaccaaaacccatccacagcgaagttggtgc

SEQ ID NO: 297 - DNA, 105 bp, Homo sapiens
atgtgtgttgctgggataaaattgcaagccagagtggttgaagtcactgaaaatgggataggagttgaactcaccgatctctccacttgttatcccagaataatt

SEQ ID NO: 298 - DNA, 166 bp, Homo sapiens
gacgcttcctggtctttggaactgacctgaggcaatgcatctccattcctggctttgactacgatggttctgcgcccagctggacaaggagcacagtccagggccctcaggtcaagatgcctcctcctcagagtctcagccctgcaccaggccaaacgggaaccga

SEQ ID NO: 299 - DNA, 473 bp, Homo sapiens
ccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgttcctctacgacccgacctctctatgtaagcaca

SEQ ID NO: 300 - DNA, 70 bp, Homo sapiens
aagaactagtatggaaacagcacttgcccttgagaagctattccccaaacaatgccaagtccttgggatt

SEQ ID NO: 301 - DNA, 190 bp, Homo sapiens
tcagttaataggtcctcagtgatcccagaacatcctaagaaacaaaaaattacaatcagtattcacaacaagttgcctgttcgccagtgtcagtctcaacctaaccttcatagtaattctttggagaaccctaccaagcccgttccctcttctaccattaccaattctgcagtacagtctacctcgaacg

SEQ ID NO: 302 - DNA, 368 bp, Homo sapiens
tgctcagatgcataaggaataccagtaaagaacatatcacctactttttctttgcttttgagagactgctctattttttatcttgcctagtgttctgatccccttggttgtaaccataagaaaatctgatgagaattatgtaggccatctgccctaacttcacaaatgagagaaaaggagactttacctggggaacctcatctcttttctgatgaaaaatgatgagtaacccgtgattgcttgaaatacaatgttgaatgggtgaataacaaagggcatgtgagatttgtggggttgcttgcatgcttcctaaaactcagcatatatggcacatcctttaaacagaaaaaggtcctctgctggttatc

SEQ ID NO: 303 - DNA, 81 bp, Homo sapiens
tgtgtcttcaagcttttccatggagtggcaaaatgattcaaatccagaaaggaagggagtgaagttattaggagctaacta

SEQ ID NO: 304 - DNA, 154 bp, Homo sapiens
gctgctcggattcggtccctgcactgccgctggtgcctcctaccgccgccgctggccggagagtcgccgcccgagcctctgctgtcgccaccgatgcagcccggaatgaatgcacagcagcgcctcgcttatccggaggtcaaacatccttctg

SEQ ID NO: 305 - DNA, 128 bp, Homo sapiens
tcctgattctggagtgcagactgcctagatggcactccttccaagcctgagaaccaaaagaccagagacgagtcctaaagcctgaaatggcatctcactgaggtctctactgagactgtgggacccgg

SEQ ID NO: 306 - DNA, 220 bp, Homo sapiens
gcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaac

SEQ ID NO: 307 - DNA, 84 bp, Homo sapiens
aagagagtgtctatcagccgaagtcaacatgatattttacagatgatatgttccaaaagaagaagtggtgcttcggaagcaaat

SEQ ID NO: 308 - DNA, 125 bp, Homo sapiens
ttgtcctgcctcctaaatatcaagaaggcaaggaggaggccacacaaagaagcccagctccatgtcctgatgatcgcatcaaaattgtggtcacgtttgccagaatagaggctacgcgatggcgc

SEQ ID NO: 309 - DNA, 1866 bp, Homo sapiens
tgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctt

SEQ ID NO: 310 - DNA, 311 bp, Homo sapiens
gcttggagcaaaggacaaatgtctctggggagaagcagagtgtctgccctcgtgttacagcacaggagacaagaggaggggtggggtgatataggacaatagctggggttctgggaattgctgttggtgtaattatcatgtcagggacagaggctgaatcacccagggatctcagttggctgccgagagggaacgatgctggcccacttcctggggtcagagagatgagagtggatggcggcggcggtggtgttgcttctcagcctgtctggaaatctcagagccaatgaccaaagcgctgtgctgccttg

SEQ ID NO: 311 - DNA, 90 bp, Homo sapiens
caaaaagccttacagcagtgcgaactggtccaaaacatgatagacttgagcatctccaacctggaagggcttaggaccaaatgtgctacc

SEQ ID NO: 312 - DNA, 118 bp, Homo sapiens
tgtccagagcctacgctgacgtccaccccatgatgatggacaggtcggagaataggtgtggaggcaatttcctgaagagggggagcatcatcaacggggcggactggtacagcttcac

SEQ ID NO: 313 - DNA, 80 bp, Homo sapiens
aatggcaaaggaccacggtgccctgcccagccgcctgctgcagggagagcagctccctcagacccggagtgctctgctgt

SEQ ID NO: 314 - DNA, 443 bp, Homo sapiens
tgggaaccaaagagactagaacctgccattttgtctcatgcaagtagcccatcctgcactgtcccgggaagccccacagcccggatggccctcaggggagcctcgcggcccttcaccgtcgcgggaaaagccaagttggtggcaggaggagcccaccaccaaggcgatctcactgcggaaaaactcgaccctccgccttcacgtctagggcggcaggtggtagagctgggcctctcaggcccatgcccgagggcaggcgagacaaggagcgcccccaagtggccatgcggtgtcctcacggaaggcagggagggcgtcacgggccttggggaccttgacacaacctggagcacgaggctgagaaacccaccacgcaggccagctggaggctgccgcccagccgggagtcagaagctggagccactgggtgctcccgaagccat

SEQ ID NO: 315 - DNA, 151 bp, Homo sapiens
gaagaaatcttgagggcccaagtgaataataaatggtgcgacgctcagaggctggcaataggggctgtcaatgaaaaaaccacctacagtggagaaaagagcagagaagcaaaacttcatgttaatctcaggcaatttggtgaagccaaga

SEQ ID NO: 316 - DNA, 134 bp, Homo sapiens
tggccaggctagtattttgtcagtccaagcagttcattaaaaaaaaaaaaaacaaaaagagcaagaatataaatactgcatcttccagcctacttttacaaagggttcactcttgggtccttaagcttagtggt

SEQ ID NO: 317 - DNA, 152 bp, Homo sapiens
cttagtggggtttggaactgcctgagaatattcctatagaaactgggtcatcttgccttctgtgccactagaacctcctgtctctccaatagctgcttctctctaattcttcaccatagttttctttctgtggtcttttgaggttctctcct

SEQ ID NO: 318 - DNA, 170 bp, Homo sapiens
cccacctgagcttgagggtagcatacttaggatttgtctatttgcagaattgttttgagagcctaaggccccataactgggaggctgtatgtgcttcatgtcagctccattagtgtctgttttatttagtgctgttttccattatctcgaacagagtcagtcatatagta

SEQ ID NO: 319 - DNA, 361 bp, Homo sapiens
tcaccagcaggaatacgaagtgtccctctgggtagccagaacgagctgacttctgttccaaggggagggtgttgaattgaggactgaaggtggagcaagagccaaggtccctcagggtcttctgtggagatttggggcttttgtcaaaagctactcaacatgtttctaattctttttccccatttagaatatatgagtagtatttgtccccaccctatcttacaaagccttcagagtgttttgaggtaatgcttacaaagtctcccagagaaaagcagaggtcctctacatccagtatcataatgaaaagcaaaaataaacttacatagtgtggtagggtggctctactcaaagaactaga

SEQ ID NO: 320 - DNA, 108 bp, Homo sapiens
gctactctgagtatttgttacagcagcagagcacatagcctatccttagacaaataggtaagtaaaacttttaacgtggtttgcctggcatgaagtaaggtaatgaga

SEQ ID NO: 321 - DNA, 116 bp, Homo sapiens
agagtatcctgtttgggaagaattcccatttcaggcaccctcgatgaagagccaggccaggaacatgggatgagagagcgaaatggtggaaaaaggggagataggctaattccaga

SEQ ID NO: 322 - DNA, 43 bp, Homo sapiens
tgtgacatccgtatccagcttcctgttgtgtcaaaacaacatt

SEQ ID NO: 323 - DNA, 62 bp, Homo sapiens
aggtgattctgacgtgctgcccgccaggcctgccctgttcgctccctggtgcatggagccgg

SEQ ID NO: 324 - DNA, 168 bp, Homo sapiens
agcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagccca

SEQ ID NO: 325 - DNA, 418 bp, Homo sapiens
agtcccaagttgagtgcatgctgttttgtaaaccacagtgtctaaactgtagcaaaaatcagatgcatagacaggttatttttaccttgcagaaaagcactgtatacagagttacaggaacaaatttgatatcatataatttaagaagctctcataatcaggtatggacattggcttatacaacatacactgtgaatcaggcacagcaacctgcaaaccacatcatcccaacagttttccattcttcctattgacaaacacttaaacacagcattttcatcatatgaaagtaaacaaaaacaacaacagaataagctttccccacactaatttctaatccaaagagctttactgcaattaatgtaaattgctatcaatcactgaattgactgggcaaagatggacttggcactgtccc

SEQ ID NO: 326 - DNA, 74 bp, Homo sapiens
gttgaggaaaacataacatcacttgttaaacagcacatccctgatgccaaattatcagccaaaagcgaaggaaa

SEQ ID NO: 327 - DNA, 359 bp, Homo sapiens
ctagtgagctgaacaggcaaggaacacagaggtgagatcaaggaaggcagaacaagaatggagcgggatttaggaattaaagcaaatctgcaattaaatataactgaagtaatggtaaatttcaagagaactagactgtaagaactaacctcacattgtgggaaaataaaaattttaaccttttccccctttatttgaaatgttctatgactacttgaaagaatttaaaaatgaaagtatttgtcagttttgtccttgaatatctttcatttgttatagaatacatattttgtccatagtattttgttttataagtgtgagggtagatttttttattgagagcctactaatatgcctgg

SEQ ID NO: 328 - DNA, 85 bp, Homo sapiens
cctctgctgataccgggggaataccagcaagttttaacacaactgagaaggaatgcgcccagctcgctacttatactgatgattc

SEQ ID NO: 329 - DNA, 223 bp, Homo sapiens
tgggtgtccttccatcatgtccaagtcttagatcagtttctagatctaggctcaacaaaattccctcccctggacccccaagccttcccagatagtcaccttcctcttccatatgtccatggcacctagtttgaaatgttcttacctcatgcatcatgttctgccttgtgttagaccctttaagcttttgtgtctcattaagatattgaactcggctgcgtgc

SEQ ID NO: 330 - DNA, 494 bp, Homo sapiens
gtcaggagccctctgtatagacaagggtagagagaagctcaggaggtccttagcagcaccctgtgggagagcagggaaggccacaggaaacctgacccctaagacctgggtccgggactcaagagaatggaaatggagaggaaccaagaggaagcacagactggtagtgggcaccctgtcattggagctatgtgaggcgataaggtttggctgtgtccccacccaaatctcatcttgaattgtagttcccataatccccacgtgtcatgggagggacccgatgggaggtaattgaatcgtgggagcggtttcccccatgctattcctgtgatactgagtcagttctcacaagatctgatggttttataaggggctttttcctttttgctgggcacttcttgctgccgccatggaagaaggatatgtttgctcccccttctgccacgattgtaaatttcctgaggccttcccggccctgccaaacttggtcaatt

SEQ ID NO: 331 - DNA, 111 bp, Homo sapiens
acaggactgagcttctgtgcctggactgaactagtaacttttacacccaggaattccaaagcagtttaaaaatactttgcttagcccccaggcagaggcttaacctccagg

SEQ ID NO: 332 - DNA, 123 bp, Homo sapiens
atgcctggccgctttccttacttcttatacaaacattaactcaaaatggactaaagaattaaatgtaaaatctgaaaccataaaaactctagaagtaaatcggggcaacaccatttaggacat

SEQ ID NO: 333 - DNA, 70 bp, Homo sapiens
tgacactcggaacgtcaagaactggaggtttgtgcaatttgagaccggtcggcactgtgcagagatcaga

SEQ ID NO: 334 - DNA, 123 bp, Homo sapiens
ctgctgatgatcagtgtcaatgccccagcaaagagtggcttttctggcatgctggtccttggacacaagggtacaaagttccatgctgtatctgtagtttataatttagaacactctgtcctc

SEQ ID NO: 335 - DNA, 128 bp, Homo sapiens
cattgaggaaggctatcggttaccccctccaatggactgccccattgcgctccaccagctgatgctagactgctggcagaaggagaggagcgacaggcctaaatttgggcagattgtcaacatgttgg

SEQ ID NO: 336 - DNA, 143 bp, Homo sapiens
cgagtaaagatctgcacgcacagttgatggacaaactcatacggggcagtttgcctgctgggctggcacacacgtggtctaccttgggaatcctaaaggacaaagagttacaacctccacgacaggcctttgccgtgtatccc

SEQ ID NO: 337 - DNA, 85 bp, Homo sapiens
ttatttaagccaactattccagatgtccacccacgggcacagagccgcagaatcagatggtatgacctgtgtgccaaagaaaaac

SEQ ID NO: 338 - DNA, 320 bp, Homo sapiens
aggtcccatcgtttcctgtgtcgcaggtcacttcttcaccaggtggctgactgcatcattgtgaggcagagccatgctgtgcaagtgtcataagtcatcccactttcaactctcaggaacactcgcagccagtgccacgctgtcctcgccatccaatattgatagccaccccagttcctgccagccagcctggcacacataaccataggatcccctctggtcatgggtcaccatgccttttcttaaactgcgcttctagtgacatggccttaaacgatggggtccccaaatgtacagtgctcctcgatggcaaggttgta

SEQ ID NO: 339 - DNA, 151 bp, Homo sapiens
ccgcgctgtgggctacgtctgagccgtcaggtcctcgctgggtctgcgggcgccctggggcgagggagcggggagccctaccccgagcaggcactctccccagattcattttggaaaccaaggcccccgcgctcggcaagtgagcctggct

SEQ ID NO: 340 - DNA, 164 bp, Homo sapiens
tgtcatagcaggatgataggtaccccgcaaacaagcacaaacagggaacgtgatgagagtggaagtggtggcctgcagccccaaattggcttgggaggatcataccatgatgacagggaagcctgcagtactccagcagacatgagagtcacccagagcttata

SEQ ID NO: 341 - DNA, 133 bp, Homo sapiens
ccagtcaccgcgcacccaccctgacccctccctcagctgtcctgtgccccgccctctcccgcacactcagtccccctgcctggcattcctgccgcagctctgacctggcgctgtcgccctggcatcttaataa

SEQ ID NO: 342 - DNA, 648 bp, Homo sapiens
tgactctggcttccgtcaagagctgtcttggaaggagaaaggagctcctgagttgaatttcaggtggacacccaccatgctaaatagaattccaagccactagcctctagccacacaggttccatcccaacactcctgtctgtgggacttgatctgaaaagccacactttggttgggaaccttgcccagggctggctggagaggggcctgttgtgccactcagggaaggccttatggttccctcatcctgggtgggcttcaggctggggctgcagactctggcccagctccctggtgggccagtcaccagcactgctggctctgagtcctgatttcttactttggctttcctggtggcacctggtttgattctggacagctcatttcacatctagcatggcatataatccagccagacctgggtttgaatcctgccactacagctcactagttagctgtgtgcccttgggcaagcccctgaatgagtcattccatggctgctgttttctcctctgtaaagcagggaagatagcgcccactttccagggctgtgctaaggagggaagcctgtgaagagcacctgtcacaacaggaaatgcagacgtgggagtcactattgttaccaccctcttgttctagcaggagaca

SEQ ID NO: 343 - DNA, 40 bp, Homo sapiens
gataaatcatgtgcaagtgtcatcgatagactaacaagag

SEQ ID NO: 344 - DNA, 195 bp, Homo sapiens
agcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaata

SEQ ID NO: 345 - DNA, 29 bp, Homo sapiens
aaaagatggtgaagttggtccttctggtc

SEQ ID NO: 346 - DNA, 212 bp, Homo sapiens
caggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaaca

SEQ ID NO: 347 - DNA, 210 bp, Homo sapiens
acctgcctgacattgccagtaattaccatcttggtatgaatttcagtgatgcagaacccctgtcagagacagctgcgtttgtaaaagcaagtctggatgacacagtgatgattacatcatctccatcttcatcgccatctcatagtaaagttaacccactgtggcatctggctgatggttttgtgggagaggattctatgtcccaccgca

SEQ ID NO: 348 - DNA, 114 bp, Homo sapiens
gagcttggagatgatgtgccccctggttttctcacatactgcctctcagctgcagagatgctgcagacccgtcattcacacctatttcaacaagccgaatacactggagtttag

SEQ ID NO: 349 - DNA, 83 bp, Homo sapiens
ccttttggggatctggcattgaagcatctgttgatccactgtctcttcgccactccttgtcgtaacacgagaagtgattccta

SEQ ID NO: 350 - DNA, 46 bp, Homo sapiens
aaataatgcttgttacaattcgacctaatatgtgcattgtaaaata

SEQ ID NO: 351 - DNA, 41 bp, Homo sapiens
aattgaattccgtgaaggctccctagtaatcaatagcaaaa

SEQ ID NO: 352 - DNA, 387 bp, Homo sapiens
agaggatcccactcgtgagcccatgccaccagggcttggctcccaaccatagaggtgtgcaaattctcaacagccacttgttctagaatctgcctaagcctgccaagttccaggggaaggggcggccatcaccactgctgcagctgcctgctttctaagccagctgagctctttgggggaagggtggcagcaacacttccactgcagggactccctgcaagaactccaacagctccagctaggggctcaggaacaaaactctgatctccctgggactgagcccctaaggggatggttggtcttagtctccacagaccaggagacttagtctttcctcctactagctctgaggaatctgggaagccctgatgagtgagtttccctcca

SEQ ID NO: 353 - DNA, 1513 bp, Homo sapiens
ctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttc

SEQ ID NO: 354 - DNA, 98 bp, Homo sapiens
ctgaagctagacaggcagcaggacagtgccgcccgggacagaacagacatgcacaggacctggcgggagacttttctggataatcttcgtgcggctgg

SEQ ID NO: 355 - DNA, 81 bp, Homo sapiens
tcagaggcacccatgtttactcagcctttggttaacacctatgccatagctggttacaatgccaccctaaactgcagtgtg

SEQ ID NO: 356 - DNA, 96 bp, Homo sapiens
caggagagcatgccttttgctgtggtgggaagtgacaaggagtaccaagtgaatggcaagagggtcctcggccgaaaaactccatgggggatcatc

SEQ ID NO: 357 - DNA, 123 bp, Homo sapiens
tgtccaacaggtgacacacatgttaagtggcagaaatggagtttgaaccatgtgttatggctctagggctcaagctcttaacactatcccaagtagggtgggaaaggacaatttgcctcactc

SEQ ID NO: 358 - DNA, 108 bp, Homo sapiens
ttcgccactggcagatcttgctatctgcaattgtgtcccgctcttgacacacgggatgacctctttgcctattgggaaaaactaatttacctcttgcggccacccatg

SEQ ID NO: 359 - DNA, 41 bp, Homo sapiens
acagttcttgccacaggaagactcgataaaaacagattatt

SEQ ID NO: 360 - DNA, 36 bp, Homo sapiens
aatctgaaagggcttgaaaagttaggatgtagactg

SEQ ID NO: 361 - DNA, 72 bp, Homo sapiens
ctagaaaaatagttgatggcagtggcttcccccccacccttccccgccaactggctgttgcgcttctgaggc

SEQ ID NO: 362 - DNA, 380 bp, Homo sapiens
cacccgaagtcatgctggcggttcatccagtggcttgcctgaaggtaaatctagtgccaccaagtggtccaaagaagcaacagcagggaaaaaatcaaaaagtggtaaactgaggaaaaagggtaacatgaagataaatgagacgagagaggacatggatgcacagttgttagaacaacaaagcacgaactcaagtgaatttgaggctccatccctcagtgacagtatgccttctgtagcagattctcactctagtcatttttctgaatttagttgttctgacctagaaagcatgaaaacttcttgtagtcatggttccagtgattatcacacccgctttgctactgttaacattcttcctgaggtagaaaatgaccgtc

SEQ ID NO: 363 - DNA, 123 bp, Homo sapiens
agtaaaagaggtatgctcttatttaaaaattcatttactaaaaactagagcttctgtatgacaaattggagaaatgactctccttaagatatcttaatgtcggctgggcaccgtcgttcatgc

SEQ ID NO: 364 - DNA, 84 bp, Homo sapiens
tgactccagagacgttcccattaaatgcatcaccaaccctagagtttaggtcctgcacattgttagctctgctgtgcgaaaaca

SEQ ID NO: 365 - DNA, 672 bp, Homo sapiens
acatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactc

SEQ ID NO: 366 - DNA, 207 bp, Homo sapiens
gtacctgcctgctaaggaacagacccacctgcctgctgtggttgtattgccagaagtgttggattcacatcttggctgcgctttgtactgatggtgtaaccttgggcaaatagtctcccctctttgaacctctgtttactctggaaaatgcccaagtctgcagattttggatagaactaaatgaactagtagtccagcaacatgata

SEQ ID NO: 367 - DNA, 228 bp, Homo sapiens
cttcattcttgagtagggacttattgtatcatccatcacaaaatcatacagtacttttatccaggaattgtagtgagggaggttgtcatagtattcagctgctattttcctcacctagaagggaaaaaatacagcaagatgaaaaatgagtgttactaggttctttcaaagatgactgatgaatggttgacacaaacactgagaagggaaaccatgagacctgcctcc

SEQ ID NO: 368 - DNA, 393 bp, Homo sapiens
tgagaggaagaactccggctccagagtctgaaagccagggctcaagtttcaatttgggcatttcccagctttgaacaacagaaaaacactgtttaccttttcagaacctcagtttccttagatctgtaaattagcaataaaaactaatgtgccttccaaggttatggtaaaaatcaaatatcttatgcctgtgtaaatctttttcaaaaaacaatagacactgcaaatattgggcattcttatgatgatgtttattcttcactgggagcattgatggattgattgttacttttcaataactttttccatatttgctctagttttaaatttgcaaattttaattcagtattgtttataataagacaaaagctcttctttaaggttggggcatta

SEQ ID NO: 369 - DNA, 199 bp, Homo sapiens
gtgcctaggcactttttatatatcagtctctcccaaccttttatgcaatagaaaatatttatcctggacacatagaaatggataaggctcctgacccagggctctggctgcctcaggccctggtgggtcacctgaagccacgcctgcaagccacccaaggtgtgctggatgggagctgtcctatctagtgtcctattta

SEQ ID NO: 370 - DNA, 394 bp, Homo sapiens
aagttgtcttctctaggtttctgcattctccttattaattcttgagcttcttaatttctaggatgtgttttctccctgtgtccttccctaatcttacacctgttgctcctcaatttgtgtgtatgcacatgtacatgtaaggatttttctgatgaatgttcagggagcagtgctgtacttagttttaccttacttttgccagattctactaaaaattttacgtgagtttagccctgtttattcaactaaataagatacttgggaatttatatctaaaggaagaatctcagtcattgtaaataaatgacctaaagtcattattgtggaaatcaatcagagaaatccctttctggagttttacatcctttttggaactcttttggtatgacagcta

SEQ ID NO: 371 - DNA, 35 bp, Homo sapiens
ggaaatgcagggcatctccgccactgggagtgacc

SEQ ID NO: 372 - DNA, 69 bp, Homo sapiens
agcagagaataaaccctcaccaggcactgaatctgccggcactttcattttggacctctcagcaacctc

SEQ ID NO: 373 - DNA, 578 bp, Homo sapiens
gtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgtta

SEQ ID NO: 374 - DNA, 108 bp, Homo sapiens
ttggccgctatttgcttacacttgccatctgtgcaaccgctctacccgtggcctcccccgctttgtggttgtcttctaacaggagcagtccacgcaaagccttcctga

SEQ ID NO: 375 - DNA, 161 bp, Homo sapiens
gtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttc

SEQ ID NO: 376 - DNA, 37 bp, Homo sapiens
tggggctgcctagctactctagaacccagacttggag

SEQ ID NO: 377 - DNA, 103 bp, Homo sapiens
gctctgctggcacttcacaaaagcgcattcacatgttggccattagtaagcatcgtcacaagtctgagaagcagtaaccctcattatcctcatactccaagtg

SEQ ID NO: 378 - DNA, 63 bp, Homo sapiens
tttttgagccacgatcaccggaagggaggaggctcatacctctggcacgtcaacagtgacagc

SEQ ID NO: 379 - DNA, 181 bp, Homo sapiens
cccttctcattaggacctggctgtggataaaaatttctccccaggtccatcccatcttatgcagtgacaatgacctgtaatgctatcctgacaccaactggtaacatactgcagtataattcccgggctaaccacccagagtcagcacagaccacacaagttccagggcatagtcctcaaa

SEQ ID NO: 380 - DNA, 76 bp, Homo sapiens
aagggacatcgctgcgtgaactctcccggcagtttccgctgcgaatgcaagacgggttactattttgacggcatca

SEQ ID NO: 381 - DNA, 111 bp, Homo sapiens
ttgacctcgctgagtacactgcggacgttgacggagttggcactctacgacttctagatgcagttaagacttgtggccttatcaactctgtgaagttctaccaagcctcaa

SEQ ID NO: 382 - DNA, 73 bp, Homo sapiens
tggagaaggataaatgggacaaagcagctctgggatatgactacaagggagagacggagaaacacgagtccca

SEQ ID NO: 383 - DNA, 117 bp, Homo sapiens
tgtagtgagttgttgaccccagatacagtttcttacagatgtgccatgttgcagtttctgatgaatatgagacagatttgatcccacaactctgttctacaaacacataaggcgtta

SEQ ID NO: 384 - DNA, 35 bp, Homo sapiens
ggagtccatgttgcctcgcctggtcttggactatt

SEQ ID NO: 385 - DNA, 1906 bp, Homo sapiens
tgggttaaatggtgctccacacatgcaaatttatgctcacctcgaacctcagaatgtgaccttatttgggaatagagactttgcagatataattagtgaagacaaggtcatcctggaataggctagaccctaaatccaatggctgtgttcttataagaagcaggaaacttggacaaacacacacagagaagtccatacaaaaaggcagctgcagagatggagtggggtggccaagaagaagccaaggactgccagtaaccatcagaggctggaagaggcaaggaaggaaactgccctgggcttggggcctgcccacaccttgatgtcagactctggtccagagcagtgtgagaatacgtttctgttactttaagccatccaatctgtggtccttcattatggcagccatgggacacagatgcaggttgtatattaaagcaataccaaccaaaatgaaacaaaaccaagtagaacatgcaacagagacagcgtatgcccctaaagcttaaagtatgtaccatctagccctttacagaaaacgtttgccaacccctgttcttgagtagaatccaaactccctatcactatcccagcgttcacagcctactgtctccccagcctcatcccaggccatccctcctccttgtagccaccactcttgccatgctcagtctcactcactgaccatccaccttttttttgcctcagggcctttgtgtacgcagctgatcacagctcatgcaccacttcctcagggcagcctctttcccatctccccacagcctgggtcgagcacattgtgacactacttcagagaaccctgacctcccttttcccaacacaatcatggggtaattaagtacaattactagctagtgataatgaattataatcaatcgagaagttcaattaactgggtgatcattcacttactgcctgcccccatactaagttgtcaactccatggggtaggggctaagtcaccagtaaccaccacagtgctttgtacagatcaagtacgtcctctagaaatatttgtgggacggatgggtagatggataaatgaatacatggattaagaggtagatggatagatggatggataggtagatggatgcatgagtagattgatggataggtagatggatgaatggatgagtagactgatggatgggtagatggatggatggaaggatggatgggcagatgaatggatgtatagatgggtagacagatgggcaaatggacagatggacagatggattgagggagagatgggtggatgagtaggtggatggatggatagatggatgggtagatgaatggatggtagataaatggatgggtaggtggatggatagatggatgaatgggtagacggatggatgggtagatgaatgggtagatagacggatgggtagatagatggatagatggatgaatggatagatggattggtaggtagatgaataggtagatgcatgaatggatacatggatggatgggtagatggatggatagatggatgaatgggtagatggatggacaggtagatggatgaatggatagatggattggtaggtggatgaataggtagatggatgaatggatacatggatggatgggtagatggatgtatggatgaacaaacataatttcaggagctccccaggctagtctggacttccagccgctcccctccatgtctgtagttagtcctaggttcctacctggcctggagtcccacctagacctcagatccaatagataaaagtgattctcttgttcccatgtctcagtagccctgtatgacaaattaaaaactgagtgggtttgaataaagggccacgaagcccccatttgggcccagatctatactgagtaggactctagacacccagggatg

SEQ ID NO: 386 - DNA, 136 bp, Homo sapiens
ggagccgtggtgttggaagcagcatggggaggctgcttctcttcccaagtccagcagcctgcagcctccttccctccgccagcccagaaggcatgtgttccaaagcccctcattaggcctctcttagcaagcaaac

SEQ ID NO: 387 - DNA, 46 bp, Homo sapiens
cctctctaaggcagtactagcgaagaccgactcagatgctgccaca

SEQ ID NO: 388 - DNA, 119 bp, Homo sapiens
caggcctttcctatgcagcactcgggacactgccacggacgggctccacggcaagtgagtggcagcaggtgtcacagaatctctgtctgaacacagggtgggcgcattacaaatcaatc

SEQ ID NO: 389 - DNA, 55 bp, Homo sapiens
tagcatcatcattgaagtcaaggcccagcatgaagacatcgccaacaacagcagg

SEQ ID NO: 390 - DNA, 71 bp, Homo sapiens
aggtgttctcaacgggaagactggaatgtttccttccaacttcatcaaggagctgtcaggggagtcggatg

SEQ ID NO: 391 - DNA, 442 bp, Homo sapiens
caccgggactggcaagatgactttggagttgccagacaagtcggcgatgtggtggtacaggggaacccccttctcaacagcactagctttgcaggcagcgagggacactcccagaatggcatttgcaccaaatttagatttattttctgttccatccatctctatcataagtttgtcaatcttctcttgttctgtgacgttcagtttcttgctaaccaggacaggtgcaatagttttattgatgggctcaacaggctttgagacacccttccccatatagcgagtcttatcattgtcctggagctctaggacctcatagataccagttgaagcaccactgggcacagcagctctgaagagaccttctgaggtgaagagatcaacctcaacagtgggattcccacgagagtcaaagagctccctggcatggatcttgagaata

SEQ ID NO: 392 - DNA, 70 bp, Homo sapiens
tctgcctcaggcatattcggagtctcatgggggtatctgtgaagaagacgagcacaagaaagcctaagtt

SEQ ID NO: 393 - DNA, 279 bp, Homo sapiens
tgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctggg

SEQ ID NO: 394 - DNA, 189 bp, Homo sapiens
tggacgcatgggaaaaccactaccccagcattgtggtgcccttctgctgagcaaatagttcaaactgttcattcccatcttctattctctccctggtacattgtttgtgcccttgcatttcattctgcaaggaaggttgctctctgggcctataagcaaacagtccagaaaagggctagccatcctctt

SEQ ID NO: 395 - DNA, 87 bp, Homo sapiens
ccccttggccctcctgttacgcttggggcccctctccctccccctcaaccccctgggtcccctgcagctgcgctcgccctagactcc

SEQ ID NO: 396 - DNA, 200 bp, Homo sapiens
catcagaggcgggataggccctccccctggcttggaccttgggcagttccccaccagaggctgtggaggtctccaacatccggcaacatccttcccaagtgcctggctcaacccttctgtgcctgggagttttctcagatgccatgggggcttgcaggactgcaagctggagaaagagaaactcccaacagttatggccc

SEQ ID NO: 397 - DNA, 772 bp, Homo sapiens
cggcacaagggattgacacgcgttccccaaatccgatgtttctgctttgtcgtggcccttcctgactctcctccgaacccagtgaggggctggtggctcccccggcatgaccccctcaaaaacgaaggggagatgttgcaagagccatgggagcgccagatggcaaggcttctttggcagtctgagaaccccaggtcccccagggcctgggggtgctgggcgggcaggagcgggctgagggtgggggccacttgggtgtttgagcattgcctttgattgctgggcagacaatacattgtttcctgtgtcttctggggagacagatttgggaaggagtggaggggaggccccaaggggggtgtggagaaaggagcagaaagggcagcattggggtttcataagcccaacgggcagaaagggacttacccccgcatgggtcttcaagcaagtggaccaagcttccttttttaaaaagttatttatttattctttttttttttttttttttggtaaggttgaatgcacttttggtttttggtcatgttcggttggtcaaagataaaaactaagtttgagagatgaatgcaaaggaaaaaaatattttccaaagtccatgtgaaattgtctcccattttttggcttttgagggggttcagtttgggttgcttgtctgtttccgggttggggggaaagttggttgggtgggagggagccaggttgggatggagggagtttacaggaagcagacagggccaacgtcgaagccgaattc

SEQ ID NO: 398 - DNA, 57 bp, Homo sapiens
ctaggagaaatggtaacacgcaaagattggtatcagtttacaccaaaacagaacaca

SEQ ID NO: 399 - DNA, 804 bp, Homo sapiens
tacactggaggcatgcccatttggcagcagatgcatcaaatttgcttttgaaaggtgcttttcattggacagaaccataagacactattttgataacattttgagtatggagagagaatacagagcatttttattatagtgctagagggtttggaaggtcatctatttttctctgaggaaaaaatgagctgtacatttatcagttcagagtaaatgacagaattgcaagagattatgctaatatgtacataatttgtgtacataattattaaaccatgttaacaatgcaagcttccgttaaacattgaattttaactattatttgcataccaattcctctgtttaaagactactgattctgtatttgggaccactgcacagatgcattctgctgttaagtgggggctgttatagttagatactgaagcagaaaaaaaagacttgactttttttttttaagtgtacatgctacttatgctgagctggacatacaggaaaccattccatttggatgactttcttttattccaggtctttttcctaatagtagttcaatatgctgctattataaacgagaatttatagaatgcaaggaatgtagcaacctacataacgttatttccttcaaaactatttcctggtttctaaagtatgtggatttaaattgtaaacagaacctgaaggcagtgtaactggcacacctcactgttacttatccccaattctgtaggatttggataggtggctggatggaccattgccattgaagaatgtacatcagggatcatcgtacctcggctatta

SEQ ID NO: 400 - DNA, 267 bp, Homo sapiens
ggcaaaaggcgttttctccacatgcagaaagtcccttgctctgagcacatacgtacacacatgctctttctttgtatacatgctgactacacgggcaggatgcaaatcctggctgcagaaaggaggcaggtcaaatcagaaccccatccttaagccctccatgtgcccacaccatatctacagaagctcagggactggaaaagacagcaaaaggcataaaagtaagggcctgtcaattacattctgtgattagcatcgtggcaattg

SEQ ID NO: 401 - DNA, 224 bp, Homo sapiens
tttgcaaccagtacagcctgcgcggggcgcggcccagtccatcccccttcggatgcgcagaagcagaggtcaccacgccggacccctcgattccctcgcgggcgattcctggctccttcaccaccccagcactccaagacccccgccctttggcctgaggctcccactgccctagccagttcccgggctcacttccagcttttccagaaagcttggccacgccc

SEQ ID NO: 402 - DNA, 37 bp, Homo sapiens
ccagctgccccaagcggggtagcagccttgaacccac

SEQ ID NO: 403 - DNA, 135 bp, Homo sapiens
tcagtttcatttgcggaggcctagccgtgaccccgcgcccaccccaaacacggatctgattcccacttgacacactttcccactggtcttagtctcacccacccgaagccagcaaccctctgcggaaaactcaca

SEQ ID NO: 404 - DNA, 56 bp, Homo sapiens
ggacttgcttctcaaggtgggactttgctgcacgctgtacaaattggttgcttctg

SEQ ID NO: 405 - DNA, 79 bp, Homo sapiens
gtcaggcattgttcccagtacagttggtagacaatcctcaaacggctgcctcttgaaagtgcacaccacgatcagggtc

SEQ ID NO: 406 - DNA, 138 bp, Homo sapiens
agatgcgcgtcacagaggctctcacactccagcctcctccagggcccaggtgggcgggcttctggccccaccccacagcgcttggagcatccctttggacgggctgctgaacatccacctgtctggacgttgcatgga

SEQ ID NO: 407 - DNA, 166 bp, Homo sapiens
gacatctgtcttaggctccagtggacccccgtgcctcctaaggcttgagtgcaggtacccgtgttcctagagcacaggacgctgtctgcggctccccatcttccctgccagctccagcctgaactcaaggattgttaagaccactccactgatccctaaagctgtt

SEQ ID NO: 408 - DNA, 48 bp, Homo sapiens
ttctggctgcttcgggtggtgaccagcttattcatcggggctgcaatc

SEQ ID NO: 409 - DNA, 815 bp, Homo sapiens
cgtgcacatgccagtaacaggaatatattaacatcttttatttgctagacaaagagcagtgtccaatataaatttcccccaaaacatttaagacctgtgaatttttgaccagttcacaaaaccaccaactgacactttagcatgaagaaaaaaacaaacctaacagactgtcagctctaaagacattacagagcagaaacttccaaaagcgttatacaagctgtctttctgggcaaatgaaaaatatagctcgtataatacattaacaaaaattcacaagataagattgttttgacatacttaacaagcattctctatttgtctccaacaaacaaagctaaggaaataatgtaaccatctttacacagtaaattaaggttacaagtcatacacaagaacagaactgcttgcgcattaaaaactgttcagctccattgtcatactctaaatgttggctcttaaaccattttcggttacatacaagcaaaggttattatatattcagcaattaataaattttcaataatttaagatacggtagcttaaaaaagtagactgagaatggtcttgataaggcaggtgaaacatcttagtggaactaaactcacagaagcttctgccaatgtttttaaatatccagattgaaactgaaaggttttgattagaatattgtgtgggtgtcaagatgtctttttttttgtaactgcatgactcaagcagagcaagtcaggtaagctctgtgtgcgcgcacacgcacgagtgtgaaagattgcgtggtattaaaacaaatggaaacttgcaagcgtaacactgtg

SEQ ID NO: 410 - DNA, 585 bp, Homo sapiens
tggaagtttcctacaaggggtgacagctctggacagggcatcaggtgcctgtgtgctcactgcaagtctgcccctggtcggctatatgatcttggtcaagctgctctgtctctctgggtccagctagacaagatgctcactgagtcccctcctgactcatttgtgattttataagggttgcctggtacatgctttctgaaggggagagcaaggggaggaggaaccaatgcagagactcaccacggacctgagtcttggcagggaggagagagcagagggagcctggggctgaggaagactgggggcaggggtgctagagatgcctctcttctttcacaaacctcctgtgctggcctgctcccggagtgctgtccagaaagcctcttcaagaaacccattacaagtgaccacaaagaatgcccgttccaagacatgcattctgagggaggtgtgcaccaaagctttagtgggcaggaagctaccccaccacccagctccagcactgctgggagctgattccagcccagccactcctcatggcttttatatggccctgctgggccctggcgatctggtttgaaaatc

SEQ ID NO: 411 - DNA, 150 bp, Homo sapiens
caggaacaaatgcaccaggaaaggcaatgtgaccaggtgggcagctgcatccagaacctgagattcagagtggaggatgccaccctcatgtcccctgatgatgctttcgtggaagagtgggggcctggcactagaatgtgttcactaatg

SEQ ID NO: 412 - DNA, 104 bp, Homo sapiens
caagtagcagcatgcgccctgcattcagcgggtggagagtggggcggggcatcgcggcgagctcctgagtccagggaacgcggcggggaatctctgtgcttccc

SEQ ID NO: 413 - DNA, 86 bp, Homo sapiens
tagtctccagtacccttctacctccacaagcttcgagattggtcccaccacttcctgccacaaaccgtcaatttcaggcactcctc

SEQ ID NO: 414 - DNA, 41 bp, Homo sapiens
gtcaatttaagccacctttcctgtgtcagggatcaatgtaa

SEQ ID NO: 415 - DNA, 249 bp, Homo sapiens
tcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaagg

SEQ ID NO: 416 - DNA, 53 bp, Homo sapiens
tttacatggaatgggtttaaggctccttgctttgggacatcacacacctttta

SEQ ID NO: 417 - DNA, 29 bp, Homo sapiens
atgcaggagcgactggaccccacatcctg

SEQ ID NO: 418 - DNA, 850 bp, Homo sapiens
ccacctgtaacgtagagcaagcaaaccaccaagtagaatcttgagattctctctcaactgttctctagaaacacgcttgtgcttttaatctgccttttaaaagggacacagaacaaaaaatggttgtttgcaaataaacatctgaaagaaagtaacagctgacctgggctgaggcatccaaacaaagcagtcattgtggaaggagacaatgcaaaccacactggggcaagaaacggggcagagaacgtgcggtcatttgtgcgttgggtatttctaccagccccaaaggccccatctggaacaagtatcaaccaggaggggctctatggcttgatttattaacctaactcaaaagaagtcactgccaccaacagcactgtgcagttttattaaccattcaagtccagtagcatctggtaagattgggacagaattgggattgaaaagtgaacagatattcagcatctaacagttcaaaagaagccactacatactcttttcacaaatatgttttcacagagccaatacagtactagccattaacccagtacaccaagtgtactgaagtagaaaagatgcaacaagaaaaatagctacattagaaagaccaacactttagaaaaagagtaaaacactttcagtttctcccctttagcccctaaaacaacatcttacagtctggatctggatctacctatacagtcctacattagcttctaaaatatttgtcaggagggaaaaaataaaatgacactggccagtacagtctttggatatttaggaaggggatggggagaaagtcagttctcagaacaaattagtcagcttcagtctcgtcagcagggtcttt

SEQ ID NO: 419 - DNA, 743 bp, Homo sapiens
tcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatt

SEQ ID NO: 420 - DNA, 29 bp, Homo sapiens
ccagccacgcgtccagcaggtcagggatt

SEQ ID NO: 421 - DNA, 82 bp, Homo sapiens
cagtgagtacgagaagatcgccttccagtatggaatcaccgacctgcgcggcatgctcaagcgactcaagcgcatgcgcaga

SEQ ID NO: 422 - DNA, 160 bp, Homo sapiens
tgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcgg

SEQ ID NO: 423 - DNA, 29 bp, Homo sapiens
ggcaaaaattcagcgcacgcatgtatcaa

SEQ ID NO: 424 - DNA, 137 bp, Homo sapiens
tgtgcaagtccgaatagagctgggttttggactggtccagggggaaaaggctgttggccaggctgtgctggatcttggccaggttgtggctggagcgaccaggcgctcccagtcaccttcggactggaagcggttta

SEQ ID NO: 425 - DNA, 76 bp, Homo sapiens
tttaatggcagtgtgttttaatggcaatgtgttttatttctctggtggaaaaaagggttatgctccagcgacctaa

SEQ ID NO: 426 - DNA, 104 bp, Homo sapiens
ctgccttgatgtgcccaccacaataccaggcgggcaagatgataatcatcgagccagctattatgagcagtataaacaaatgacaaatctctgggtgcaggaaa

SEQ ID NO: 427 - DNA, 563 bp, Homo sapiens
caagttgtctttgttatcggcatcatctgttgctttctgagggaagtattttgagttctcctactgagactgtggatttgcctatttctttttgtatgtcagcttttgccatatgtattttgtagttgtgttgtgaggaagattcatgacttatcttgtgggagaattctgtatttagcagattttcgtcttaagttctgttttgcttagtattgatgttattactttgctttttcagtttcaaaatcatttagtatatctttttcctttcttttagcctttgtgtttttatttcagatgtgctttcttatgtactgactgtgatccccaaattcatatgttgaagtcccaactccaaatgtatttggaggtgggcctttcagacgtaattgagtttagatgacgtcatgagggtggagcccccatgatgacactaagtccttctaagaaaaggaagagagtctgagccctcctctacaccatgtgagggcacagagagagagcagccatcaacaagctgagagaggaggactgagaatgaaacctacctcgccagaaccttg

SEQ ID NO: 428 - DNA, 1698 bp, Homo sapiens
ggtacctgtgtatcaagaactgttggtatgtattgctaatttgcatacaaagagtttgtctgtctgcattgtagtttgtgtttaatatcatttgttaaattcacaaatacaacatattgaataaaatatttatatgaaggcatattaaaaaacatcaaacaactttatgtaacaaaatggcattgcattactcaccaatatagagaaatgtcatgtaaataagttggtaaactcaatttccccctttaccatgccaaagaaaattttagctctttgatgatacctctcttgctatttgtttgggataagacttcgccatttttttcccctcagaaattaagtttgctgttattaagtaagaagtgcaatctgtcactactgatgttccgtatagtaaatctgatggaattcatttgtatttagactgtgtgttttgtacctccatgtgcatatgtccattgtatcaagtctctataatactccattccttctgcatgcatatctggtgtgggagggttatttctactgatttgttatagtagctgattgctttgccagtccctcaacaacgctcagaaatgttgttttggtatttcaagtgacaacatttttgttttctaatataagattgctttttaaaacattttgctaccactttacttggaaaaattagagaagacatgacaattctccaccctatgtaaagagcaaaatggaactgaacatcatttcattacaaatcctgaagaatttggagattcttgctctaaatgtttgcttgtcctgaatgtttttgggtagcagtggcttaaagagatccacgatgggtccaaaggactcccgctccagttcttctaatagtttgcctcttggggagcaagcagaagttctttatcatacctagccacttgcttaattaatgctttaagcactaaaagttgttatttttatcaggatgaacaatatcagatttggttgtctttaaaagcaaaaaccaaaaacttattctttaagtaagttagacacgtatcacttcatttaaaattatctccctaatattatggatcattaatatttgatacatattcaaaaagagaccacattgactaacatccagttgagaacaagatgaaaataattgaaatattttttccattttaattcagaacaaggctatatcaagggaaagcgactgggctaaatcctcaatttttttttccaaaatgcaggcatatcaaaatccaggatgtacatggtcttactttgagtgaaatagtagtcatagctgaggtttcttagcctacaatgtgacatagggcctgttgactctcttgaatatggagtagggtttcaaagtgttgacagttgagtctgcaaactaaggctgagttatattttagttttttttttttttcctggttttcactaagtctaattccaatgtctactggcagagattgtgtttgcatttgaggtagtggagggcggtactttccaagtgctgttggaatccagataaactcaaggagcccagaaagacaacgggtataatggctctcctcttatgacttagcactttagttgacttttttgaaaaagtctctgggtggaatacctcagtgatgatgatttgccaaacaagcagcgttagtgccaacaccttctctaaacttgctgcatcccttccaattgacatta

SEQ ID NO: 429 - DNA, 163 bp, Homo sapiens
tccctttttgccgagacgcaggtgaaatgatgtcacccaggagaacgcggaacccggtcgaaagggtcctctctggcgtccttctgcttccgtgggtttctggataggctgcgttttgttctcaggggatgcaagttcttcctttcagggttgaagcgtgaga

SEQ ID NO: 430 - DNA, 206 bp, Homo sapiens
ctacatgccctctgtgttgacactagtagggatcccaggcctagaatctgtgcagtgctggattgggattccattctgtgccatttatctcattgctatgattggaaattccttgcttctgagcatcatcaaatctgagcgcagtctccatgagcccttgtacattttcttaggcatgctaggagccacagacattgcacttgcta

SEQ ID NO: 431 - DNA, 122 bp, Homo sapiens
actagcttgagtggattcatcttgctggaaagagctgacagactggaccagtttgcattccgaatgtagggattcccgtggatattctctgtcctggattgagggctaatgggcaccttcca

SEQ ID NO: 432 - DNA, 76 bp, Homo sapiens
ttgcccaagacgtaagacctctagttgtctgttgtctgctctcagcgtcatcatattgatctagttttccagctca

SEQ ID NO: 433 - DNA, 242 bp, Homo sapiens
acggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggc

SEQ ID NO: 434 - DNA, 202 bp, Homo sapiens
ctgtacagctaccttctgggaaatagtttttgacacctatttttcagattcttgtccggaatttctgctgctcttttcaaaaaagggcattaacaattctctggaaataaagcacctgttagcctgacatatgcaaaaagcagggcggcatcacccattacgagctcccccagccagcagtcagtattggattggccttgcc

SEQ ID NO: 435 - DNA, 138 bp, Homo sapiens
ctgagtcacagaggacgcaaaggcagagagagaccgagggacagcggctgaccaaaaataaggggagccaaagattagccgctagagacagagacgtagaaacggataagagataaagtcattgacgcagagtccgag

SEQ ID NO: 436 - DNA, 90 bp, Homo sapiens
ctttcagtgttctcagtgagtgcttcacagattaggtttccaagagaagaagattgcctctgaggaagaagagatggggtagcaagaggc

SEQ ID NO: 437 - DNA, 28 bp, Homo sapiens
tgtttgttgtttggttatgatcttgctt

SEQ ID NO: 438 - DNA, 193 bp, Homo sapiens
ttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgt

SEQ ID NO: 439 - DNA, 68 bp, Homo sapiens
ttaaaccacaacgactggattaagcagtatgaaacactagccgaaatggtagttccaaggtctagcaa

SEQ ID NO: 440 - DNA, 58 bp, Homo sapiens
aggaacaaacagctcagattacacgggtttccttgttggtgggggttactcgtctcac

SEQ ID NO: 441 - DNA, 532 bp, Homo sapiens
ccaggtgcataatttcccatcagtctgtccttgtagtaggcagggcaatttctgttttcatgatcggaatactcaaatatatccaaacatctttttaaaactttgatttatagctcctagaaagttatgttttttaatagtcactctactctaatcaggcctagctttgctcattttggagcctcactaaaataacagatttcagtatagccaagttcatcagaaagactcaaatggaatgatttacaaaatagaacactttaaaccaggtcagtcctatctttttgtagctgaaggctatcagtcataacacaatttcgcgtacacctctgctcattatggaattacacttaaaacgaatctcaagagggtgaccattgttgtttcagataccatccctaaggagagtggttaacaggaagattgccagtgttactgatggaaagaagtgtttgtttgtttttttttcttgtcaaagacttacaccatagttttaaattaaactgtcaggcattttctcagacaggttttc

SEQ ID NO: 442 - DNA, 675 bp, Homo sapiens
accataggagttactgtctgtattgtcctagtttttgtattggataggagattcagaaatgcttaccacattattaaaaaacaattaaagaaagcaagtaaaagagagccatgttgtgtcctgaatcaaagattaagattgagatttacccagttctgtgtatttgagttccaacagagagaatattcttgccttacaggagtgttctagcctccatttaccagattttaaagcataatgaaaagtgatgatcattacattccattgcattttattaacaacaacaacaaaaactggagcctaaaatttccagaaatagatccagagagaaaatgttaagaaccatttgatctagcaatcccactcctgggtatctacccaaaggaaaagaagtcattataccagaaagacacttgatggcagtacaagtcacaattgcaaagatgtggaaccaacccatcaaccagtgagtggataaataaaatgtggtatctctacaccatggaatatgacttagcaataaaaaagaacaaaataatgtttgtggttttttttttttttgcagcaattttggatggagctggaggatattattctaagtgaagcaactcaggaatggaaaaccaaatactgtgtgttctcacttataagtgagagctaacttatgggtacaaa

SEQ ID NO: 443 - DNA, 137 bp, Homo sapiens
acgtgtcatcagtggaggtgctcatgaactaccaccagggcctgaagactgagctggaggcgcgggtgcctgagctgaccacctgccaggagctggggcgatctctgctgctcaacaaaagtgccatggctgatgag

SEQ ID NO: 444 - DNA, 54 bp, Homo sapiens
ggattcttggaccatccagaggacaaggggcggcccctcttcaaagatctctca

SEQ ID NO: 445 - DNA, 328 bp, Homo sapiens
gtcgagttatacaggactagccatctaacaggtcatctggtctccgacggttgtttaacgacacacagtagaaatagagaatagaacccatatctgtttccagagtccaaagtagtatatcaggctgacagcactcaatcagtgagggctcctgaggttgcaatgattctgcaacggagtagattctctaggaaaaaagaccttgctgctaaggaaagagaattaaaaacaaaacaaaacgaaaagctccccaaagaggtactctgctcaaaatggctggtgctactggtgcactaagttgtgaggaattacctctgctcgggacaga

SEQ ID NO: 446 - DNA, 114 bp, Homo sapiens
gacaagagttaactgcccatctcaccaaccagtggccttctccaggagctctggatgtcaatgctgttgccttggatacgttgctttaccgaaaacacaataaacagtggtatg

SEQ ID NO: 447 - DNA, 402 bp, Homo sapiens
ccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtg

SEQ ID NO: 448 - DNA, 282 bp, Homo sapiens
ggggtttgttaatcagatctccttaaggttggaagagtaaattctcccctctccatccaaaggggaagatgcctgtgtctcctgggttttttccaggtggaggttttgttataagtaaggtttggctgttaaatatcttcccttttttaagagttctaggaaggaagtgtgtttgaggaggtttgagcctgcaaagtggaagtgacactgtgggttgcacggtttggccactgacttctcacgtggtttcagtccttagcaccgtggtattgacatgacatc

SEQ ID NO: 449 - DNA, 248 bp, Homo sapiens
agctcctttgttcctaaaatcaatgccacgtccccagcttacaactccttgttcctaaatcaacgctgcgtccccagcttacaactccttgttcctaaatcaacgccacgtccccagcttacaactccttgttctaaaatcaacgctgtgtccacagcttacaactccttgttcctaaatcaacgctgcatccccagcttacaactccttgttcctaaaatcaacgccgcatccccagcttatagctc

SEQ ID NO: 450 - DNA, 61 bp, Homo sapiens
tcagagctgaatctgtgggcagagctggcttgtctctaggagagacatggcactagctgag

SEQ ID NO: 451 - DNA, 242 bp, Homo sapiens
gtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctccccaagaattctagggagtaaaatgcgtgcaca

SEQ ID NO: 452 - DNA, 76 bp, Homo sapiens
gaagagcggaacatattatctcgaagcacaagcccgtggatcccccaattacagtatgcctttcaggacaaaaatc

SEQ ID NO: 453 - DNA, 85 bp, Homo sapiens
ccacattgcattgctgctgttttcacaacctctctgcactaggcggcttcctgtggtacctcttcctaccagtagagagtggccc

SEQ ID NO: 454 - DNA, 91 bp, Homo sapiens
tgaggactgggcctatatagaatccagataccattgtcaacttcccttattcccgtctaagatgtgagcagagtgccatagtaggggttct

SEQ ID NO: 455 - DNA, 258 bp, Homo sapiens
gtggtggcccaattgtcacagcctcctcagccctgggagctcaccacactgtgccacaatgccccagcttgaagtgacatgggacactaagtgtatctgttgcaaatattagaacccaactcacactggcttaaggaaaaaaaaggaaaacgaagaagaaggagaccataatggcacatggaactgaactcaggggtggctgtggcttcaggcatggttgtatccagggagaacagtatggccaagatccttccctca

SEQ ID NO: 456 - DNA, 54 bp, Homo sapiens
gctctggttggaaagtggctagggtgacctctgggcctactggcagggacgcca

SEQ ID NO: 457 - DNA, 114 bp, Homo sapiens
gcttcttgtgttcccacaaaacagcttctgttcaaacttctgcccagagcaactccatctccagacacctctccaaccccagtaaaaatcccaaacttgtgtaaacacgcaaag

SEQ ID NO: 458 - DNA, 267 bp, Homo sapiens
tcaggcgggtggcaaacaaacatcacataaaggagagtgtctggcttgtgtcttctgggtacgtgatccccctgacttcagtgtgagaatgtggccagagcgtctggggaagacagggagagttgtcagagaggagttttgaggaggccctgaaggctcgccggctgttaaggcctgagctgtagtgggcaagaagagatggccagttcaggtagaggaagcctgctttgagctgaagaccggaggtgaatctggacagggcttccc

SEQ ID NO: 459 - DNA, 102 bp, Homo sapiens
ccaaattgtgaagattgaggatgtctggggagaaaatgtcgctctcacatggactccaccaaaggatgatggaaatgctgctatcacaggctataccattca

SEQ ID NO: 460 - DNA, 88 bp, Homo sapiens
agtgagttgggttgtaaggagagtagcacggagccatcaacaaccacgcaaaatgtcagcatccctgaaggacggagtggaggcttag

SEQ ID NO: 461 - DNA, 451 bp, Homo sapiens
acagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatg

SEQ ID NO: 462 - DNA, 29 bp, Homo sapiens
atgacacccacaagtgcacgaaaaagcta

SEQ ID NO: 463 - DNA, 347 bp, Homo sapiens
tcaaaagagtgtgggactggtgtcccaacagaaaaatagatccttggaacagaagaaagaggcagaagtagatccacatgtgtatagaccgtggattttagaccaaggcatgggggcaattcagtggagaaaggattaatttttcaacaaatagtgtcaaaacaagatatccataagcaaaaaatgaacatcaaaccatattttataatatatacaaaaatgaacaccacatggacatatatgtaacacctaaaactataaatcttgtggaagaaaacctaagaaataatctttgtgagattgggttagacaaagatttcttagatatgacactgaaagtgcaattc

SEQ ID NO: 464 - DNA, 176 bp, Homo sapiens
aggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccaga

SEQ ID NO: 465 - DNA, 53 bp, Homo sapiens
gatttggttgttagggatggaatcaaacaagacacgggatttgagctgatctt

SEQ ID NO: 466 - DNA, 122 bp, Homo sapiens
tccggttggctaggcctgaattcccagcagtttccaagtgccttggacgttggctccatttccggaccctcctcagacattcattgagcaacaagctgatgctaggcttgtcccacattctc

SEQ ID NO: 467 - DNA, 87 bp, Homo sapiens
gacacattcagctaacgtattttagcaggtggagtgaggttgaagattcctgtgacagcgatgccatagagagaatgtactgtgccc

SEQ ID NO: 468 - DNA, 173 bp, Homo sapiens
tggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaatttta

SEQ ID NO: 469 - DNA, 37 bp, Homo sapiens
aaatgagaagtaacgtcagcagctccgtaggttctga

SEQ ID NO: 470 - DNA, 74 bp, Homo sapiens
tctcagcaaaaggaccccggaaacattgcaaactattctaatacctcagtttgaattgccactgagcactctag

SEQ ID NO: 471 - DNA, 123 bp, Homo sapiens
tggggcccacgaacatcccagtgtggccctggacgggacatcatgctgggcaacacagctaaaatgcgggtgaagaccagatttcttgcacatggcggtgacgggatgctccctagagagctt

SEQ ID NO: 472 - DNA, 37 bp, Homo sapiens
cggcaacagctgatcgcacggatgcagcaggaagacc

SEQ ID NO: 473 - DNA, 548 bp, Homo sapiens
ccttggcaaactgacaaggatgtcatatatgtattgtagtggtcaaaattaatgttttgtttacttttttttttggagacggagtcttgctgtgtcacccagggtggagtgcagtggtgcgatctcggctcactgcaacctccgtctcctaggttgaagcaattctcctacctcagcctcctgagtagctgggattacaggcacgtgccaccacacccggctaattttttttttttttatacttttagtagagacggggtttcgccatgttggccaggctggtctcgaactcctgacctgaggtgatctgcccaccttggcctcccaaagtgctgggattacaggtatgagccaccacacctggcccttttttttttttttttaactcttcagagacagggtgatgataatttctgtttagcatttataagatgactcactattagtagtcctatccccatattatttaagctctaaatttcctgtggaaatttagacttggaatatagacttggaaaacccctcaagcgttgcttctcaatgtgctc

SEQ ID NO: 474 - DNA, 282 bp, Homo sapiens
gtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtg

SEQ ID NO: 475 - DNA, 107 bp, Homo sapiens
tgtaagtacccttgttatccaagcggcaaatgtgtcagctttgtacaaatgtgaagcggtcaacaaagtcgggagaggagagagggtgatctccttccacgtgacca

SEQ ID NO: 476 - DNA, 160 bp, Homo sapiens
cccttggactgggagtttagcactatcacctgcacactagacctgcagtctatgaagagaggctgtcagggatttggggctatcacagttgctcctcccagagcaaaaaatattcaaccctcccacacacacaggcagcagcctcatctcaaatggactg

SEQ ID NO: 477 - DNA, 31 bp, Homo sapiens
atggaatatggagcaaaaggggtcctgtgct

SEQ ID NO: 478 - DNA, 156 bp, Homo sapiens
tttcttagcgcaaagcagtgagggcagtacatgttctttttgcatttttaattattgtaatccttttagataatgatgtgttcatttgaactaactacatactatgatcaagtatattgcatcctaacgctacctctgactcaacctgactttgta

SEQ ID NO: 479 - DNA, 31 bp, Homo sapiens
tggaaagagatcatggaggaacgttcccata

SEQ ID NO: 480 - DNA, 30 bp, Homo sapiens
gagaaacatcgaaagcgcagcctgcagccg

SEQ ID NO: 481 - DNA, 742 bp, Homo sapiens
ggcttctactacgtatttggcaatataaatagataattagatataaggaattttgagtcatatcctttaattcctttggccaaaggccatttcaaataaaatgtttatttcagaatgcatataaaaagtcagtagtgctgctgggcgtgctggctcatgcctgtagcccaagcactttggcaggctgaagcaggaggatcacttgagcccaggagtagaagaccagcctgggcagcatagtgagacccccatttctacaaaaaaaaaaaaaaaattagccaggtgtggtggcacacatcggtagtcacagctacgttgagaggctgaagtgggaggatcccttgagcccaggagttccagcctgcagtgagccacgatcacaccactgcattcagtctgggtgagagagagaccctgtcttgaaattaaaaagacagccagtaggatgctccagtggaaaaagatgaagactttatgtattttccctcccctacctagtcataataatttgtgactatagttggctctcgacttttcttctctctgtaaaagtttgtattagaaatagttttctaatttctctacttcgtagtttctttccccaacctctcacatctagttcattagtgtttggtgagaattgtcttcccgtttccctttcatagctagtttaggctcttagcatttcggatctcgattactgattactagccaagcttgttgccttcatgtacacctgtca

SEQ ID NO: 482 - DNA, 195 bp, Homo sapiens
catgctcctcctatctgggctgcaatcagcacagtgaggagaggagcgacagagcacatgattatgaccggggcttgctgctgagctgcaggggttcagagtactgctacctgtgcaatggcagcttccccagagcgcccaggggctccgaggccacagacagaaaatatctttgctaccacgtgctgaaaaata

SEQ ID NO: 483 - DNA, 387 bp, Homo sapiens
aagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgta

SEQ ID NO: 484 - DNA, 63 bp, Homo sapiens
gcacattgaagaagtgcggaagaacaaagaatccaaagaccctgctgacgagactgaagctga

SEQ ID NO: 485 - DNA, 37 bp, Homo sapiens
ttgccattcacctgtcccgtctccaacattaaagctt

SEQ ID NO: 486 - DNA, 49 bp, Homo sapiens
ctttccctgatacacctgcctgtgaaccaccctgatcgctcttcgtgcc

SEQ ID NO: 487 - DNA, 429 bp, Homo sapiens
ctcaagggtgaagaatgagtcttacctgacacacattagataatgaacaagctcaagtcttaaaatcctgatttattttaaactagtgcttagacatgactgtggttcaagtttggcagacaggtttaaatgtcaaatccaacactagagacaataccatttatttcagttaaggaatatagactttgccaccaaataattacatatttttcattcctgtatgacatggatgcctctatttgcatgacctctgagtatgaagtaataatatattaattttcaacaactgatctgtctgaaaaatacaaagaaacagcaaaatggtgatattaaaactgactcaccactgtcctctgtttgttgggcaggaagactctaacgataggtttttgtggtgacttggggttgctccgtgccacatctgtggga

SEQ ID NO: 488 - DNA, 245 bp, Homo sapiens
gattgggcatttatgatatggcaggaactccttctcacatggagacctgatgttaaaggacacagccatgctcttgaggagcttacaatccaagctggaggcaggggagggtatagtctttaaatatgcttaagtgttgtagggaaggacagagttaccaataaacatgtaactagaaagccaggctcagttcttacctctgggaatcagaactctttatgaaacttgattgatagaatctacta

SEQ ID NO: 489 - DNA, 74 bp, Homo sapiens
ctcttgcaaatttcacaagctttggctgtgctccctgaaaaatcagcagcagcaatgtccttcaggcagcagct

SEQ ID NO: 490 - DNA, 67 bp, Homo sapiens
cttggggctcggattcttgaatctttatcagtgggagtcagaaattgcctttgagttcattggcatg

SEQ ID NO: 491 - DNA, 567 bp, Homo sapiens
tgtccttttgccagtcttagagtgaaagtcatagacatgagtcttaacctactgtatactatagctaatgtcagctgaaaatctgaaattaaaagcatgctagaaatcctaaatgcaatcttttggaagtctgctattaaaaagcctttaaggatttactaacttcgagtctaagtgcaaggggacgaaagcttaagcctgtcagacattccttttcttggacaaaaagatcaaagtttcctacaaattgctaagctttgcacaagggagaagcctacatgtactagtgcatggaatcagtttcatcttatttcatggggactcttctcccactggaaagaaacagaatgaggaatgaatcttaattggtctcttcatcagaagtggtaaacttggtctctatattcacgaagtcagacagttttttaagcagactgtggaagcagacagaaccagcttcctgtagccacagaccactacatggtatctaagctaaagcaaagatgaacaattatccagattcacttgaactgtactaaagggcaaggttcaccactacaaaaagga

SEQ ID NO: 492 - DNA, 579 bp, Homo sapiens
ggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttcca

SEQ ID NO: 493 - DNA, 86 bp, Homo sapiens
agcaacggaagaaacgcgagcaagaacgaaaggagaagaaagcaaaggttttgggaatgcgaaggggcctcattttggctgaagat

SEQ ID NO: 494 - DNA, 31 bp, Homo sapiens
gagagtgatatgaaacggaaaggcaagctaa

SEQ ID NO: 495 - DNA, 34 bp, Homo sapiens
ctgagcacctccaccgactggaaggaggcgaaat

SEQ ID NO: 496 - DNA, 32 bp, Homo sapiens
atggcacaaaacgatgcagatgggcatcacct

SEQ ID NO: 497 - DNA, 34 bp, Homo sapiens
gaatgtaagggccagaaagcttgaatgcccagaa

SEQ ID NO: 498 - DNA, 119 bp, Homo sapiens
cctcctactcttctgactgtggactctgtcactgacacgactgtcacgatgaggtggcgccccccagaccacattggtgcagcaggtttagatggctatgtgctagagtattgctttga

SEQ ID NO: 499 - DNA, 100 bp, Homo sapiens
tctgaggcacatacacagctggttggcagttctgcttctaaagctgtggcactccccatcttaaaggttttgaatctgcctgctgttccagacatgggga

SEQ ID NO: 500 - DNA, 139 bp, Homo sapiens
acacgagtgggaagctaagagagacacggggagggggaggggaccgggaaccatttgaatgagaggaggggatcacgggtagagtgggctccaggaggtagggcgagcagggtgtgacgggggccagactcttgagcca

SEQ ID NO: 501 - DNA, 210 bp, Homo sapiens
agctgaggtgctgttaagaaaattctgatgtctgggtctcactccgaaccgattagatcaaaatctttgaagggtgatagggttagggcggtgggatgttgggtattggtatttatgaaggtgctctaggtgattctagtatgtaaccaggggagaaccagtgttttggagcattcatttaaaaataaactgactttggcgggcgacatg

SEQ ID NO: 502 - DNA, 39 bp, Homo sapiens
gtttgggcgtcatcaacagtacttctatttgtaaaatgc

SEQ ID NO: 503 - DNA, 53 bp, Homo sapiens
agttgcatcttccagggaagcaggctcccagtactttagtcagccccagtggc

SEQ ID NO: 504 - DNA, 31 bp, Homo sapiens
gccagcctgaagtcacggtcctggcccagca

SEQ ID NO: 505 - DNA, 39 bp, Homo sapiens
aggatccagagagcacccaatttacccagacccagcgag

SEQ ID NO: 506 - DNA, 49 bp, Homo sapiens
tgccacttaggcatccctgagcatgtctgttcatgggtaagatggggtg

SEQ ID NO: 507 - DNA, 29 bp, Homo sapiens
aacagaacagaagttaggaatggtgaaat

SEQ ID NO: 508 - DNA, 386 bp, Homo sapiens
ctaccgaattggatacgttgagctcaacggtgctctcagaagcgcggtggctcatgcctgtcatcccagcactttgggaggctgaggcgggtggatcacttggggccaggagtttgagaccagcctgggcaacatggcaaagccccatctctacaaaaaatacaataagtagccaggtgtggtggcgtgcacctgtaatcccagctactcgggaggctgaggcacaagaattgcttgagcccggaaagcggaggtagcagtgagccgagattgccaccgctgcgctccagcctgggcaacacagcgagactcgcaaaaaaaaaaaaaaaaaacaataacaacaaaattgctgtgccctctctctgggcctttctccgtatgtttgc

SEQ ID NO: 509 - DNA, 119 bp, Homo sapiens
cttgatcctgcatatcaggttgacaaaggaggcagagtgaggtttgttgtggagctggcagatccaaagttggaggtgaaatggtataaaaatggtcaagaaattcgacccagtaccaa

SEQ ID NO: 510 - DNA, 31 bp, Homo sapiens
acaagaagatatacgatggaggtgcccgcac

SEQ ID NO: 511 - DNA, 189 bp, Homo sapiens
agagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatg

SEQ ID NO: 512 - DNA, 48 bp, Homo sapiens
gaaccaaccacactgtaccaaaatgagctgttccctaggtcttgtccc

SEQ ID NO: 513 - DNA, 202 bp, Homo sapiens
tatacaggggccgtggtgctactcagggtttgaggaagggagagaacctttgaagctgtggtaagggagagctggggcattgatctgggatgcagaggttgctgtggttgagagctactccagtgagcaacatgatggcttcagagtgagcaggccccatgggagagggcccagctgtgtcttcctggagcggtaacacctt

SEQ ID NO: 514 - DNA, 132 bp, Homo sapiens
agggctgacattccaagactgtaactctaaggaacacaagtccttcataaccagcaaggatcccactccctctataaaaagcctgccaggaggccaagccaggagcgtaagccactgatagggctgtgtctc

SEQ ID NO: 515 - DNA, 172 bp, Homo sapiens
cactgacagcacattccacttgagaccagtgctgcgggactggggagtgcaagcgtcagggtcccagccgaagccctttagcttgggacttcacagccacagcctgagtcccagctcacaactccagaccaaattcccctcccagctcatgtgctgcgatcaagacagatgc

SEQ ID NO: 516 - DNA, 80 bp, Homo sapiens
ctagaagatagaattgtgctgggctccctcgacctcactgactttctcaccttctctctgctgccttttgatccctcctc

SEQ ID NO: 517 - DNA, 298 bp, Homo sapiens
gcacacggcgaccaactcaaacataaaatttaagttcagaatctggattcatgcaatcttcagcaagtctttagtcctcttcaaatatttatataataaaggagccctaaaaatagctagacatgcacaaatgaattgacaggaagctgctgtttcagagtccaaatgtccttattctcttcccattaatatctttaaggtctttctacggccatctctcctccctctcttcacatgctctggccagtcactcaccgtaggaatcataagtctcctcactgagtccatgtccgtaatc

SEQ ID NO: 518 - DNA, 119 bp, Homo sapiens
actgagccgcttcactggagcactaatcgatttgctgtcaaggtggcctgctggggtttcaagccagagaggaattgagaggcgctctggcccaatttccataattgctcactgccttt

SEQ ID NO: 519 - DNA, 125 bp, Homo sapiens
cccagaaaatgagaacacggacacagaatctccatctcacattgtttcctgctctgcctacttcaccacagatgacagcaaaggaccaagagttacaactgcttctcatcagagccctggatcaa

SEQ ID NO: 520 - DNA, 390 bp, Homo sapiens
tgcccaaattgaaacttgagccctggctttcagactctggagccggagttcttcctctcacccttcagctagctgcattaagtcaatcaatcaataaataactttttattgcctgttctttctcttcctcctccttattctaatcaagatattttaagttttgaattaaaaatttatctcattcttatggcaaagtaggtttcaagccatttcacggaaatttatacaagtgcctttgtgctacaatggctgaaccagagcacccagctctcaggcagtccccactgtggagacagagcctgctgtcccactggacagagcctcaaccctggctgactcacagccctgtgtatgtcacttggcagcttcttccagtagcatgtccttcca

SEQ ID NO: 521 - DNA, 112 bp, Homo sapiens
ttcttgtcattgtgggaagtgcatttgttctgctgaagagtggtatatttctggggagttctgtgactgtgatgacagagactgcgacaaacatgatggtctcatttgtaca

SEQ ID NO: 522 - DNA, 52 bp, Homo sapiens
ttcatggagtatgtggcagaacaatgggagatgcatcgattggagaaagaga

SEQ ID NO: 523 - DNA, 98 bp, Homo sapiens
tgagttcagtcttgatgcctgcctgggttcagttacagccctgcccttcccaggcggcctcaggttaccgccctgactgccccgctgagtcggctggc

SEQ ID NO: 524 - DNA, 53 bp, Homo sapiens
gcagtgccactcctgccgaccgggctggttccagctaggaaaagagtgcctgc

SEQ ID NO: 525 - DNA, 228 bp, Homo sapiens
actgtctgtggcctaaagtactttgtactttgtccgtgtagctcagaatattaaacgatttttaaaaggctgcttccttgggtcagtgtggtgtgcttgagttccgggaatgcagcaaaatgaagtttagaaataatgaaattgaccaatgcttcctatctctgtagttggccattgtggggtcagtgtttactgatctttgctcactgtcctgatgagataaacttg

SEQ ID NO: 526 - DNA, 42 bp, Homo sapiens
aattaaattatcaactgtggtcatctgcaatgaagtgactaa

SEQ ID NO: 527 - DNA, 246 bp, Homo sapiens
tgactgtacagatggcgaggccatcacggagacagatgattccagagaaagaacagtttctgatattttgacattccaggccaagaaactatgtaaggacaaacaaaagatcctgaattatacggccccactagtgggtgaagtctcacttcaagaacatgatggcttgactacatatgcaataataagagaagatgaaatcacactccagagagccagtacaccaccgtggaagaaagatatttg

SEQ ID NO: 528 - DNA, 146 bp, Homo sapiens
gatatttcccgccagtccatcgttggtttttttaacctcacgctagtcttttttgcggtggagaagtttttcttgttcatggccctatctgttgagctttcccaaaatagcttctagtaagtgttgtgtactccaagcaatctgtc

SEQ ID NO: 529 - DNA, 74 bp, Homo sapiens
agcgctctggccgagcaccagtgtgccagccagaaagcacacctctatctgcgggagcagagctcctttcctgc

SEQ ID NO: 530 - DNA, 704 bp, Homo sapiens
ccaggaggctgtattctgctttctcctcccttgctttggctgatcgcaccccttctgtcaagaatacagcactcccatttccaccatctttgtttggccaaccccagtccgtttctcagactcagctcaagcactgcctcctgctggcagcattctccagtgccccaatgctgatttgcctgtggggtaatgttctgtgcctatctcatcggtgcacttagcacagtgtattataattttgtatgttctttctccctcgcagcagtccgagctccttgagagcaaggaccatgtaccttttcatctttacatatccattgcctacatatttgttgaacgaaagttcctagcacagcccctgtcccataacaggcctttaaatatcaagcactatttttttttcctccctttcccgcaacatgcagacatacacactttcaccaacatttattagctccgactgcatgagatacaatgatgaataataaatgatccctgcccccaaggaattggaaatacaaagcagagggaggagcaagcattaaggtttagaagccagagttaggttttcttgcaaggggggaaaaaacactgttgggttgatgggaacccttcgtgggaaaattgagtagagccttgaaggttgtgggaaaagctttctaggtggccagaagtccctggacaccactgatgagcctagtttg

SEQ ID NO: 531 - DNA, 486 bp, Homo sapiens
cgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaa

SEQ ID NO: 532 - DNA, 120 bp, Homo sapiens
ggaatgcctattgggaaggtgctccagccaaagaattcaagggaccagaggtcaagaaagagcagagaatcaaagctgggccccttgtggggaggccgaagtcaggcaaaacaagtgaca

SEQ ID NO: 533 - DNA, 57 bp, Homo sapiens
cttatcttcgggagatacattccaaggcccccagtgaactcctgaaacctcaaacag

SEQ ID NO: 534 - DNA, 80 bp, Homo sapiens
tggcaggacgcaacaactccatcttctgtgacttctcctacagaaggcccaggaagtgtgcactcggatacctctaacta

SEQ ID NO: 535 - DNA, 71 bp, Homo sapiens
aggaagcctggccgaaatgtgcttttggataaaatgtcccgattaaccaagagcacacaaaatgtgcagac

SEQ ID NO: 536 - DNA, 111 bp, Homo sapiens
agcggtgtaccattgacattgacgagtgtatctccaagccctgcatgaaccatggtctctgccataacacccagggcagctacatgtgtgaatgtccaccaggcttcagtg

SEQ ID NO: 537 - DNA, 317 bp, Homo sapiens
attgttattgggttgtcgctgcttctaggacttttgagtgggcagacttaggaaatttttgttcgttttttcttttaagagacagggtcttgctatgtcacccaggctgaagtacagtagcagttcacagacagtcatagctctctgcagcctcgaaatcctgggctcaagcaaccctcccatctcagtcacatgagtagctgggactacaggcatgcacctccatgaccagctcctggctgtattttttggaaagagaacaattactttattttctctctggcatcagatggtagacgctactagtcccatttttg

SEQ ID NO: 538 - DNA, 380 bp, Homo sapiens
tgctgtctttcctcaggtaagtccattatatgcatctaagtgctggggaggtttaaatagcacttaaagaatattcatgagagttctgaaatgaaggtttcgtctttagctattgactgtaggatttgtaattcaaatcatcacagcatcctaaagaaatactgtgtgaatggaatgcacacaattcctacagaacacacaaactgatgtccaaaaggcacagagtaatgctggtggctctttctagtcagttaagaaacaataaaaagtctgcattattctttcataatttaaatacttaagtaatctccactttattattttataacaatgacttcaaatttacattattttaagtaccattgtaatagcttagtgta

SEQ ID NO: 539 - DNA, 115 bp, Homo sapiens
tctggaagttatcaataccgtggcacaggtcacttttgacattttaatttattactttttgggaattaaatccttagtctacatgttggcagcatctttacttggcctgggtttg

SEQ ID NO: 540 - DNA, 57 bp, Homo sapiens
ccagagtgggactaactggacttgaaggactgattgagcctggattggatgccaagg

SEQ ID NO: 541 - DNA, 223 bp, Homo sapiens
ccacgtgtttggtgttggttatacattaagatggggcgggagtgagaacaatctcttaacattcattgaaaaaaatactgaaacatattttcagcacaaatattaaactgtctcttctctaccgattggtaaaaaaatatattatattttgattttttttttctttttaaattatatggttatccatcccagccaaagtcgtgcccggtcatctggtagaact

SEQ ID NO: 542 - DNA, 30 bp, Homo sapiens
gagaaaagagagcacgcaaaacaacatggg

SEQ ID NO: 543 - DNA, 465 bp, Homo sapiens
gtgaacacatcctactctgcttctgattctcaacttactgtttttgaagcacatgaacaggccaggcacggtggctcacgtctgtaatcccagcactttgggaggctgaagtgggcggatcatttgaggtcaggagtttgagatcagcctggccagcatggcgaaaccccatctctactaaaaatacaaaaattagctgggcgtggtggcacatgcctgtaatctcagctactcgggaggctgaggcaggagaattgcttgaacctgggaggcagaggttgcagtgagcctgggcaacagagtgagtgagacttatatctcaaaaaaaaacaaaaaacaaaaaactgaaagacatgaagaaatggtttttgtaccaaggtttggcccacgctgagattcacaaagaactggctttcagttcttatctttattttgatttaaactggcccatcatgttgtcctttg

SEQ ID NO: 544 - DNA, 75 bp, Homo sapiens
tctgcttatattacagaggggagctggggtgaaggctggggggagccagcaggacgagttctgaagcctcttatt

SEQ ID NO: 545 - DNA, 488 bp, Homo sapiens
caattggagtctagcagggaataccagatcaatttaaagcctaaaatcaaatagctgcaggatttgagtcaatattttgttgagagacaattaataaaaatatagattgaataaactacatatgctacaaccaacagcgatttattaactacactagagatggtgttaaaggaatagctgagcaattaggggctactagccggatggcttgggaaaataggataggcttagacatgataatagcagaaagaggaggagtttgcctcatgattaaaactcaatgttgtaccttcatcccaaacaacactgcccctgatggaagtataacaaaggcattgcaaggtctgactgccctgtccaatgagttagccaacaactcagggttaaatgagccctttacaggatggctagaaaagtggttcagtaaatggaaaagaattatagcctcaattctcacttccctggcagccgcaatgggtgtatttatt

SEQ ID NO: 546 - DNA, 222 bp, Homo sapiens
atggtaacacgctggctagccctgctgggtccatgcctggagctggggtggggcttattcccttccggacctcatgggctcggagaggcaagtgatgggtctctgaatgaaatcagtgctgggttcatggacacggaagggagggttgttgttacttctgttttactggtgaagaaaacacccgtgttcactactgtcctattggcagcgaatttgaacacc

SEQ ID NO: 547 - DNA, 55 bp, Homo sapiens
gtttgtcagactctcgggaccatgctgttgaaaccactaaaccacgctgcctctg

SEQ ID NO: 548 - DNA, 32 bp, Homo sapiens
ttgcatacatggatgaggagactggcaacctg

SEQ ID NO: 549 - DNA, 59 bp, Homo sapiens
atggcgtcgggaagagccagggacccggctgtgcgcttggatccatcactgctctgggc

SEQ ID NO: 550 - DNA, 135 bp, Homo sapiens
ccatggggaagatcgtaaagttgtcttccaaaaaggcccaccagaaataaaaattgcagatatgcctttgcattcgcctctctccagataccaaagcactgtgatttcccatggcttcaggaggcgactagtcta

SEQ ID NO: 551 - DNA, 195 bp, Homo sapiens
gattattgagtttcgtatgcttttcgaatatggtaggatgttaaatgtggtaaaaagaatggctcttaaatgtgtttcatagatcatatattaagcttgactagtgagaatatttttcatccctctatttttagttatacatatcttgaagccatttcttctgttttagaatgtcagcatatgatttgctaggtc

SEQ ID NO: 552 - DNA, 80 bp, Homo sapiens
tagaaaagaccgaatacaggacttgatcgatatggggtatggttatgatgaatccgactccttcatcgataactctgagg

SEQ ID NO: 553 - DNA, 33 bp, Homo sapiens
gcttgttaaattggcgttccaactcccagaaca

SEQ ID NO: 554 - DNA, 34 bp, Homo sapiens
agaagaggagcttggggcaataacatgaattctg

SEQ ID NO: 555 - DNA, 280 bp, Homo sapiens
tggggctacaactcatgttccttggctcccggttccagctgctttctaccacacagcactgcatcttcagctgcccccatgcagatttatattgcatgcctctgagtcttatgcttccttggcaaaccaggcagtcgcaagctccagtgcctactgggaccaatgaggttacgtgagtaagtgggctgaatgtagtacaacagattctgctggaaagtgtggtgatctggagagcacatgtcccgtctaaaacaaaagactccaggttctcactgcagga

SEQ ID NO: 556 - DNA, 277 bp, Homo sapiens
tgttgacagtggacgatacaccctcccttctctctccgacagggtcgccatcaaacccagttgaagagggtccagtgagagcctattagaggcttcacaactcacttgccagcagcagatttctcccatcgcttagagactgctcactcacaccactcctcagaagacctccagcaacatacacagccaggaacgacaggaaggaagggacatgacatttactgaacggcagtgctgaaccaggcactgagccagggcctgttactaagggcaaagc

SEQ ID NO: 557 - DNA, 66 bp, Homo sapiens
aggggctccccccagacagtgtcaggagacctgatgggtgaaggagggatcagtcggcacagttga

SEQ ID NO: 558 - DNA, 143 bp, Homo sapiens
tgtgtccaagaaagtgtggctagtaaaatagactttggagatgggccgaagtatccactgattgaagaaaacagacaagtccaaggaggaaatgcatacaaggcagaggtggtaggcaaagaggagtataagattgacaagga

SEQ ID NO: 559 - DNA, 169 bp, Homo sapiens
cctccagctctaggctgcggggatcccctctgccattgaggcctggcccctctatactgggccctgagcatgtacctggctcccccagtgtacccgagggccttgctgtcactggatggattgaacaactcaaccgagtgtgcatgctcatgctaaccaacattcagtc

SEQ ID NO: 560 - DNA, 107 bp, Homo sapiens
cccagagcctctcagcatggcgtttgcaggagcacccctccagacctccacccctatcggagccatgggcacacctgctcccaagacggccttctccttcaacactt

SEQ ID NO: 561 - DNA, 191 bp, Homo sapiens
tggctgataaatctgtggacatgtgaaaatgaagtgcagcttgctatattatagcatccaaactgcaggggagccaacaaacatctaactctgcccactcattttaccactggggcgaacgaggttcagggaggagcagggactcacctgagcccaggaatagggaggctcaacggaaactcaggccattg

SEQ ID NO: 562 - DNA, 86 bp, Homo sapiens
ggatccgcaaccaggccgacaactgccctagggtacccaactcagaccagaaggacagtgatggcgatggtataggggatgcctgt

SEQ ID NO: 563 - DNA, 82 bp, Homo sapiens
aaacgtataccagagacgaagaggcactttgaatttgtccgggtaggtgcttcttggtttggggatgttatgaccttagata

SEQ ID NO: 564 - DNA, 245 bp, Homo sapiens
aaatgttcttggttagggatgtttgaagaatagaggaagtgggctgggcacagtggctcatgcctgtaatcccagcactttgggaggctgaggaaggcagatcgcttgagcctaggagttcaagaccagcctgggcaacatagtgagacccccatctctacaaaaaatacaaaaattaaccagatgtagtggtgtgctagtccaagctactccaaaggctgaagtgggagattgggtagagccca

SEQ ID NO: 565 - DNA, 318 bp, Homo sapiens
cagtcactccacctttgacacattactagtaacaagaggggaccacatagtctctgttggcatttctttgtggtgtctgtctggacatgcttcctaaaaacagaccattttccttaacttgcatcagttttggtctgccttatgagttctgttttgaacaagtgtaacacactgatggttttaatgtatcttttccacttattatagttatattcctacaatacaattttaaaattgtctttttatattatatttatgcttctgtgtcatgattttttcaagctgttatattagttgtaaccagtagtattcacatta

SEQ ID NO: 566 - DNA, 173 bp, Homo sapiens
tggattccaaataatggggcttctcataaaagatttggaccctgccccgaggcttttggtaataaatgtggccgctttgtttttttccctaattatttcattcgtaaaagtcttatcttcccaataaagatggtaactcctctggactgggtctgcttttcgcattttccttc

SEQ ID NO: 567 - DNA, 116 bp, Homo sapiens
agggctgtttccagagcagtgaatgacgaccggagagcatgggaaccccttttctttgtagcagcccatattaatgagatctctgtttctctcaagacagtcagggccgtctggtc

SEQ ID NO: 568 - DNA, 266 bp, Homo sapiens
tgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacc

SEQ ID NO: 569 - DNA, 70 bp, Homo sapiens
ggtccgagtccgctaccagaagcgacagaagctgcagtttgaaactaagctgggcatgaactctcccttc

SEQ ID NO: 570 - DNA, 47 bp, Homo sapiens
aaggacagcagtcacctccgacaatgctccgttctatggaatattga

SEQ ID NO: 571 - DNA, 101 bp, Homo sapiens
gtcaaagttgaacagcaactcgggggcagggaggacgtcaaggcctggtaggacaagcgactctccatggtttctctcaggttctgagactctaggcaggc

SEQ ID NO: 572 - DNA, 792 bp, Homo sapiens
attgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgcc

SEQ ID NO: 573 - DNA, 70 bp, Homo sapiens
agcatctcccagagggctgcgtgcctcagaaaagccggcatccctagcccgctctggcacaggccatgag

SEQ ID NO: 574 - DNA, 486 bp, Homo sapiens
tttactaggttgcataatgactcccaaaatttacgtccacttggaatgtcagaatgtgacttcatttgcaaatagggactttgtagatgtaaagtaagcatcaagatgagtttatgctgtactagggtcagccctaaattcacttctaagagacagaaggacacccaggaatacatggaaggccatgtgaaaatggaggcagagcttggagtgatgcccgccacaagtcaagggatgctgggagccaccaaaaactggaagaggcaaggaaagtttctccccgagagccgttagtgggagtgtggctctgctggcaacttgatttcagacttctagcctccagaactctgaggtaataagtttctcttgttttaagaccccaggtttgaagtagtttgttacagcagcccaagaaacaattaatatgtctgaaagtgctaccagatgatttgcatgtctctttagagtgattaccctgacaacata

SEQ ID NO: 575 - DNA, 31 bp, Homo sapiens
gacaagtccttcacttctcgccggagtgtgt

SEQ ID NO: 576 - DNA, 170 bp, Homo sapiens
gccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactg

SEQ ID NO: 577 - DNA, 188 bp, Homo sapiens
aggcctccaactccaacaagaagtgtaagcgttacttcaacgagcactggaaagaggagtttacctggctggactttgactatgagcggaagctgatgttctgcctcgagtgccgccaggccctggtacggaacaagcatggcaaagccgaaaacgccttcactgtgggcacagacaacttccagcgc

SEQ ID NO: 578 - DNA, 221 bp, Homo sapiens
cctctctggaaacaacggcaccatgagccacgtggagcaccaagttcctgtacaagcgggacccactgtgaggtgtgccaccccatcaggcggtgtgaggaccttttgacgccattagcagagtggagtagaaaagagtttagtgtctccccaaatcactgggttcttcaaaaagttgttgggcaaatgctcagaacccaagttaaggtctcaagcaagtc

SEQ ID NO: 579 - DNA, 402 bp, Homo sapiens
tgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgag

SEQ ID NO: 580 - DNA, 182 bp, Homo sapiens
agtgctttggagtgtatttattttcaaaatgatccatgattggtttaaacatgcaaagaaaaatgtactggaagcttgtcaatcagaaaagagtaattattcttccactttgaaaagttcatatgaagtgggtaaattctgcaagctaagagcttggcaagggctgttgtaagttagttttg

SEQ ID NO: 581 - DNA, 134 bp, Homo sapiens
tgtctaccctaagcaccaggctggacacactgggaaacaggctgaccacctgggctcccaggccttctacccaggacgtcagcatgactacctagtcccacctgctggcacagctggcattcctgttcaaaatc

SEQ ID NO: 582 - DNA, 69 bp, Homo sapiens
gaaatttattactagcttgctacccacgatgaaatcaacaacctgtatctggtatcaggccgggagaca

SEQ ID NO: 583 - DNA, 31 bp, Homo sapiens
actggttgaacagcggatgaagatatggaat

SEQ ID NO: 584 - DNA, 65 bp, Homo sapiens
tgaagaaaaataatgtgggtagccgggcttcatcttagcaacacgagcacctcattttggttttc

SEQ ID NO: 585 - DNA, 73 bp, Homo sapiens
ttgggaagccagtagtttgggcttagtgacagctgctctgcatatggtaattgttgctgcctttacatgggct

SEQ ID NO: 586 - DNA, 44 bp, Homo sapiens
gcctcccgcaaatggctggccaatagggactcgccgccatatac

SEQ ID NO: 587 - DNA, 96 bp, Homo sapiens
ctacaattttgtgagtaatggggaccacgggcatgggacagtttcacccagaggagctgtgatctcccaagagacatcagcagttgtggtcttgcc

SEQ ID NO: 588 - DNA, 76 bp, Homo sapiens
gtacaacccagccagcaggtcaaaggattggaggaccaccctgaacagcatgggaacaactggattacaacagctg

SEQ ID NO: 589 - DNA, 203 bp, Homo sapiens
atggtgtgtcaaaccatttggaacaattttttcattgcttagtgatttataaagtgctggtgtatcttaatagcagtggtgtcttagacttgcagaaatacagtacatcataaataatacattaaagtaggtctgcctcttacaatgtgtataccttcagacttctaccaaatcatatgtgcagtcttagaggtttctaggta

SEQ ID NO: 590 - DNA, 210 bp, Homo sapiens
cctcactcatagtcagactgttgtgtctcaccccttacataacatccaagtgagatttctcacagtgctaccttggcaacaaactaaaaatatctagacaaggtcttggtttaagccttattaaaaaagctttctttgtgattatctggtatctggtttggtctccagaaaatacatagacttggagataggaaggcctcacaggacttc

SEQ ID NO: 591 - DNA, 47 bp, Homo sapiens
ctgcagtgtcatgggcaagggcccctggcccacatgcccaatgccag

SEQ ID NO: 592 - DNA, 86 bp, Homo sapiens
cattacattatgacgagacccaggtacctgaatcttggatccagaccttagcccagggagatgactggattggtaatgacaaatgg

SEQ ID NO: 593 - DNA, 588 bp, Homo sapiens
ttgggaggcctcaaccattcctgaggtactggtggtggcagttgcaagtatcttttgctgcactgaaggaggcaatgatgacgctggtacagatttcacttcagcatgggctggaatctgtaaatgatgcccagaaggcaaaactggagacttcacagtcactggaagactctgggtattaactacaataaaagatgagtctttttgtgttgagggaggaacagcaaatgtttgcatggtgagtccatcaattttcacaccatgactctgaactttagaaactgatgaagaaaaatttccagttcccacagaagtaactctacctttttctgatgtatctactgttcttgtaagaaaatagtttgaagaactggctggctgaaaaatgggcaattgaactgatgcacttgtggaagagctggaaatctgagtctgaaaagtaacttgaactggttttcctgtattccctttcaaagcatcagacatgactgaagattgaactagtggtataagatttccagaagacttaggaattggaagtaattgcagaagattttttccatccgagccaatcgtctgaactacttg

SEQ ID NO: 594 - DNA, 34 bp, Homo sapiens
gattatccagactttagcccatcagtggatgctg

SEQ ID NO: 595 - DNA, 391 bp, Homo sapiens
ccagctttgcccttatggtaggttgtccttgagtcttttcccgggtccctggtttgatgggctgttgaccgtaagaagtacggtttctagagcacctactaccggcaggcatgagttttaaggacttgatattcttcccaaagaacagtctcttgagtttcatttcagaagtttttaccacactctcttaccatctatactattttctttacttgatagttttctttaaataagactcagacctgacatctatagcatcttagcctcatcttcagagatgccattggtaaaattataggcttgatatactagtcccagttttttctaacatataaaacaattttaagtgttcatctatgaatcacctaatgcactcacgtagccctaatgg

SEQ ID NO: 596 - DNA, 1360 bp, Homo sapiens
cactagacagcaattcagagcctccaaaataaagaatattcataaaagtaacaatagaggtaaatataaaacccagaattactacatgtgtcatatagtttataacttctcctatttatagctttctatatttatatttatctataacttcataggcaaatgaataaaaattataaatatgatagtggtcatataatgtataaagatgcaatctgtgacagtcttatgaagcagggatgaagacatataggatcaaaatgtttgcatagttattgaagctatgttgatattatgaaattatattgttacaagtttaagatgctaattataattctcaaggtaaccactaataaaattaccaaaattatgcagaaaaggaaaaaagaaaaacaatacactataaaaaaccaattaaatacaaaaaaagtcagtaacagacaacttgagaaacaaagacatataagatatagagaaaacaaatgattaaatggcaaaagtaaatcttgttttagtaatcacattaaatagaaaaggatgaagccatcctattaaagggctgagactgacaagttggctaaaaactaaaataaattaaaaagaaaaacaagactcatctacatgctgtctataagagacttgccttagatataaggacacaaagaagttgaaagtaaaaggactgaaaaagatattccatacaaacagtagtaaccaagatagtgccgagtggctatatttttgtcaaacaaaataaactaaagtaaaatttacaagagaaaaagaagggcattatgcattgacaaaaattttgacatagccaaataattatgttataaaatatatgtacttaataatacagcctcaaaatatatgaagcaataattgctataatttaagggagaaaagaacagttctatgaaaagttagagaatgaaatattccactttcaacatgagattaaacaactagacataagatcaataaggaaatagaaaatttgaacaacactataaaccaattatccctaacaggcatatacagaagaatctacccaacaagagcagaatattaattcttctcaaatgcacatggaacattcttaaaccatatgttaggccacaaaacaagtgttagtaagtgtgaaaatttgaagtcataaaaagtatcttttgcaattacaatggaatgaagctagaaatcaataactagaaaaaccagaaaagtcacgcatatgtagaaatttaaaaacccgctcttcaacagccattggtcaaagaagaaatcacaagggacattagaaaataccttgagacaaatgaagtaaaaatacaaatagcacgtttatggtatacactgaaca

SEQ ID NO: 597 - DNA, 223 bp, Homo sapiens
tggatcaacattcctgtcaaacttaaaactgtctttgtgactatatggacctaaatgcaggctcttcagaagttcaacaataagctaagcatttgtttgttttgctttggatgttgtgctgcttcagccccctttaaaaaaaaaaaaagagagagagagatactttaaacacacagaaaaattcggtgtggtatataacaagcacccaggtagcatgtgtcta

SEQ ID NO: 598 - DNA, 260 bp, Homo sapiens
gaggtctataaacagtcgcactgggagagtctgccttatgcggttgagataaggactgaaatacaccctggcctcctgcagtaccctcaggcttactaggattgggaaaccccgccctggtaaatttgaggtcagaccagttctctgctctagaaccctgttttctgttgtttaagatgtttatcaagacaatacatgcaccgctgaacatagacccttttcagtcattctgcttttgctctttgtcttgtgatgtttgt

SEQ ID NO: 599 - DNA, 240 bp, Homo sapiens
ccaggagatccacaggtccggcatgaacagtgagaggtcagaggtggaaggctcagcaggagaggagaggaggatcagcagaggtcatgagaaggccagaatccagggtcaggctgtctggaacaggaagtaaaatgggccgagatggagcgagcccccagtgtgcttccaaggccactcccacctccctgaaacaccctgctacgtactgatccaatgccctgcgctgtgtatgagagc

SEQ ID NO: 600 - DNA, 86 bp, Homo sapiens
gaattgttgagagggtttatgcccagagacatcccagaagcactgaacgcactcatgccaagatgttaatacctttcctcactaaa

SEQ ID NO: 601 - DNA, 34 bp, Homo sapiens
cagcagcttccaggttgctctgatgatatattaa

SEQ ID NO: 602 - DNA, 29 bp, Homo sapiens
gtgagtggactggtgccaagcatgtccca

SEQ ID NO: 603 - DNA, 123 bp, Homo sapiens
accagctacaggtggaatgcccaagtgtgcgagagagcagcttggatggcataatggatatggtggttggctcctcgatggcatctctaccattcctaatgcggtttgaaaattgtgctcagc

SEQ ID NO: 604 - DNA, 1223 bp, Homo sapiens
aggagcctgttataattctgcaagatctgtgaatagcattataaatctggggcaggtgcctgtaatcccagcactttgggaagccaaggcaggtggattgcttgagcccaggagttcgacaccaacctgagcaacatggcgaaaccccgtctgtaataaaaatacaaaaaaattagctgggcatggtggcatgtgcctgtaatcccagttactggggaggctgaggcaggagaatcacttgaacctgggagatggagattgcagtgagcagagattgtgccactgcactccagccagagtgacagagcaagactccatctcaaaaaataataataaaaataaacaaatctgtttaaattactgttgcctttcagcattagactttgagtttaataactacaaattgagactgctcacaatattaactttttttgtaggttattttgttgtttagataacttgcctccctagaggagcattcaggagataaagacctagctacatgtaatgatatgatcatttcaaaaatgtgccaagaaagcaaaattcattattgaactctaaatttctgggtgtttttttttttaaagtagcattttctctgggtaaagggaaaggcaatgaatgattgccaacatgtaaactccctgctgcccgccttcccccagtcccctccatctaacataatacagtaaatttgtagccagttgtagaaaaagaaattgatatctttctgagtaaggtttcatgccctgtgactaagaataggtggaggaatcatggccaaatcaaatatgaattgtttagcttggtcctgttgcagttggctttctgtagtgttctgaaacaagaggacgattccattccttctcaggaacctagaaacaacaccgcttgagcaactggaatatgtttgctgcaagcagaatattttggggagaggaagagtagtttaattcaagtagtttaattgaacatattagtcattggtctgtctgggacgtgcagtgttcatagtagcaatgtatgtaccatttattttatctggttgtgtgtgatgtgtgtgtatgcctatttaatatgtacacatatattcactacatatgtatgtatgatatattcatatatacatgcagtctgcttgattatcagcaaaatggtcagcctttatcagatagtttcttcatgtggagttcatctgcatgtggcccttactctgaagc

SEQ ID NO: 605 - DNA, 859 bp, Homo sapiens
ctgcttgcatgctaggagctccctccccagcaaggcccgggccagagagagaaggaacagcccagagccaggagaaaagggagagtgaggctttttattgtgtatgaattcacgtggtatcgacaactccacacaatattaaaacactgcgagaaagtgggtgcggcacacctggaattttaaaaaagtcagaaataaaaacaaccagacatcccaatgcagatggcatagaacctgctagaaccacaggcggcggctggaaacaggagacaggtctttacgaaggttagatgggcagcggttccgtggacagaggaggaggcgcggctggccggcatatggcttctgtgcagagggcctggcctcaggccgtggactttttaataagtgaccccttgaggaagggcgtggtggctccacctccacccggaagcccccccgggtcactcacgggcggacaggtgtgtgacggccctctcctacctgccccagaacttgggcaggacgggctgttaacttggagatggatgcgtggcctggaggcctagcgttgcgcctcggacacggtggccggcccgtcaaagggaccacgcagaaggagggaaacaggagcaccttccgccctggcccagccgccccgtttatgtccccagaggccagaggtcgcagctgagctatctgtgcttggcctggggttacccctggggagggtgggagaggggtgagggttctggctccttcctggagagaggagggcaggggaggcggagctggtccgggaaggtgcccaggtgggtcacaacagggtcggggcctggcccgctgtggcccttcacctggctactggtgtctcgctcag

SEQ ID NO: 606 - DNA, 123 bp, Homo sapiens
aagtttggtgcgaacgccattctgggggtgtcccttgccgtctgcaaagctggtgccgttgagaagggggtccccctgtaccgccacatcgctgacttggctggcaactctgaagtcatcctg

SEQ ID NO: 607 - DNA, 91 bp, Homo sapiens
tcagacactctgcatgcttgccagagagctcgctagaggacgtgcagaaggtcaaagtcctccatcaccagagcaagttcagccaccaggc

SEQ ID NO: 608 - DNA, 196 bp, Homo sapiens
ccagaggcattgatgcgaaccagcagcagcggctccgccctcacaggacacgtctcctgggccaggagaagagaggggcccctgagcatccaggaccagctcctgaccctggaatgtgttcagcctggagctctgtgtcctgatgttctagaatagggccaaagccaccccctcctcttgggtctgactgattagg

SEQ ID NO: 609 - DNA, 36 bp, Homo sapiens
gcctcatgggcgcaaacactcgggagcacacgtgga

SEQ ID NO: 610 - DNA, 563 bp, Homo sapiens
ctttttaacgtcaccagatggggcgggaggtggggggttcacgccactcccgcgtcccacctccacgcccggggccgtggcccccacatcactgtgcagctccccggccccagccgcgcctccggggaagcccgtttttaacctttcatccattgggactcaaaactgtgagacgcgttcgccaaactgtgaccccagaccttggccccgccacacagaaacccctgacccagactgtgacatccgactcctaaaatggtcatccgactccagactgtgacccctgaccccaaactgtgacccgaaccccagactgtgccccgaccagactgtgacccttgacatcaaaccgtgacaccccctcctcctcttccaccctcggtcgcttttccctactctgacctaggacacgtccccaacggaagccccgccttcccttgcaccgcgatgaacccaacctccctgaagccaaaacttcccaccctgccgcacctccggaccaccccacttgccaccaagcacatcctctccaaatccaacccttatttgcgacccttcagtga

SEQ ID NO: 611 - DNA, 162 bp, Homo sapiens
cctgttaggccagaaggagactgcacccttggactggcaagtcagtgcaaggccctgctaataggactattgaagactctcactatgggttttctgtggggtgtttgtttcttggggtgaaagcttccctctccccaggcaggcccagcaaaatctgtagga

SEQ ID NO: 612 - DNA, 228 bp, Homo sapiens
gatagcaccataagccaaacatttatgctaattttatgtaaattatgtgctatggtccacgccccgcccccacatgcgattaaaaagttgatttttagtgtgctaaagcacatgctaaaacagatgctacattttcaaaaggcaagggtcttttagaatgcttgatgtctgtgaggttgacaggagcaatattaaataaatatacatacactgtttaaggattctgtg

SEQ ID NO: 613 - DNA, 74 bp, Homo sapiens
acgcgagtctgaagctcaggcaagaggctagagttacatctttggagtcatcagcctaatggaggactgtggca

SEQ ID NO: 614 - DNA, 86 bp, Homo sapiens
tttagcataattagtagtgagaaggaacttaagaatttaacagaattagaagatgaacatttggcaaaaagggcaagacaaggtga

SEQ ID NO: 615 - DNA, 89 bp, Homo sapiens
atgaaggaaaccaccctagacctagaacacggccaagacactgtaaagctgaagaatagggagaaatttctgcatgaggctaagcaaag

SEQ ID NO: 616 - DNA, 429 bp, Homo sapiens
ttccaggttgggtgtagaatcaaaccagcgactatcaataactttcaatttgttggagttcaggtggagccttaatagattttttaagcctgcaaaagcatgagcagaaatagtgctaatttggttgtggttgatgtagagttcttgaaggttgctgaggtcttgtagacagtaatcagtcatctcggtaatctgattttcctccaaatgcagcgttgtgagctgggttaggtttgccagcccgacctccttaatgttagtaaagttgttttgggagaaatctagttcagtcaagttgaaaagctgctgcagctcatccacagtctttgcgatgttattgctctgtaagagaagcacttgtgtgtcactagagaggttactgggaatccttgttaagcggaggtcattgcaatcaacagtggtggcttc

SEQ ID NO: 617 - DNA, 110 bp, Homo sapiens
tgcagctcacacagaagggactactgcaaaggacccaggtctaccctggccattgacattagagggccagggatcctccctcaccccaccttctgcacgcttctgtaggg

SEQ ID NO: 618 - DNA, 68 bp, Homo sapiens
tttggattcacatcgcggaaagtccctgctcacatgcctcacatgattgaccggattgttatgcaaga

SEQ ID NO: 619 - DNA, 213 bp, Homo sapiens
gtggtgtgtgtacttgttatatttagccacctccctctgttctcccccactgatcctggctggaaaggctgggcttccggaaaagagaggtggatttgcacacctggatcccaagctgatagaaagtggggtgaagacaaaggggactcagactggggtgtctgtcctcttctatgcccacagtaggaggagccaggattggttactccctgc

SEQ ID NO: 620 - DNA, 354 bp, Homo sapiens
ttgccacttgtgagatatagatttgtacagatgtgtccctgaagccacatatccagatctgttttaaacttgccatcctgtttccatattccagagcaaacatttgagagagatgggagaaaacagtcaagaatttatttttgaatttaattattcattcatatgtttaacaaaagtttattaaatgcttactgagggcaagaaaccgtgtaggcaaaatagataagaaatgaacagcggccttcccctcaaggcatttagtttttcatggtagacaggttcataaacagctaactggaatgtattgcagtaagtgtttaaataaaggtacgtgcaaggtacttagggaccaca

SEQ ID NO: 621 - DNA, 131 bp, Homo sapiens
acacgtgtgtcccacccatggatgatggcaccagctggggggtgcacacgtgtgtcacacccgtggacgatggcatcagccagggggtgcacacgtgtgccaccttcttcccggccctgaattgtgtgtga

SEQ ID NO: 622 - DNA, 149 bp, Homo sapiens
cacttctctttggtaggaggttctcttccagctctgtgccttaaattaaccgaacatggccatggttccagaaatttgcctgccctgatctgttcactatgatgattatgtacatgattccctggttccagatctgcactcactccata

SEQ ID NO: 623 - DNA, 127 bp, Homo sapiens
gtcagagcgaatggggccacatcaacagaaagaagaccctgtgaccatggagaaaccaccagtcacaggaccttccccatcacccccgcccccgccgccctgggcactgtgcaaggctggatcccac

SEQ ID NO: 624 - DNA, 1007 bp, Homo sapiens
gctcttggggaggatacttaatctctcacctgtagaatggggcaaggatggcatgactcagggatgtagtgaggattacacaggacatgtagtcaagcacttaacacagtgcttagcggctccccagcttcccacttccaaggcttccttttactttctctcttggatcccatgttttgtcaggatgatgtctaccaaccaaaatgcatttaggaagtattggttcacttttccctttttcttaaaccaagacatcttcaaatgtctgctagagctctggtcaacatggaaccccggtattaacatactgcatagatgtaattccagcaaaaagcaaagaaacaagacatcttacatagcttgtgtggtcttaccaagggaaaattcatggtttgtgttcatcttttgaaatagtaaaaataactcgtgagtttcatttctactttcttggagccccagtcattgcagaatctaccacagccacagatcccatttcattctctcctgccccctgaggcttttatccttatcctcattttcaaggtgaagagactgacggcaggtgtagttcccagccttttcataatttttcattcacctctttaaatggcaattgggacctggggcagtggctcacgcctgtaatcctagcactttgggaggctgaggtgggaggatcacttgagtccgggagtttgaaaccagcctgggcaacacagtgagaccccatctccacaaaaaattttaaaaagtgggtgaatgtggtggtgtgtgcctacagtcctagctgcttgggaggctgaggcaggaggatcgcttgagtccaggagttcgaggatgcagtgagctatgatcatgtcactgtactccagcctgggtgacagagcgagatcctgtttcttaaaaataaataaataacgcaattgggttttagctggaaaaaagcagtgaaggaggagggaacctatgactctcaggctccaagatgacgtgcctggtagctgcca

SEQ ID NO: 625 - DNA, 34 bp, Homo sapiens
attctaggggccagtcgttggtatccagaggcag

SEQ ID NO: 626 - DNA, 382 bp, Homo sapiens
gtcacatgtgctagatagttctccacagagaagaccttggtcttcaggatgtcaggcaaacctcctgactcaagcactgaaataaacacaaatcaccattatgaagtcaaatctataaacaagcttggaaaccaatccaaaatccctcagatccacacctatacactcagtgactcatgtctatgagccatggtgaccatgcccagggttggggtcagaagaatcaggggaagtgcaatagcaaggggactcttccacagccttttttgagggttcttcagtcctggctaactctgcattccatttatgatgcctatgaggaatacaagaggagcttcaaataagcactgggtatatgagcctggagctcaccgaagtcaga

SEQ ID NO: 627 - DNA, 543 bp, Homo sapiens
tggctaagtcacgaataggcatttcaccatatgtacatgataaatggccaatcaaaataaggaatggggctcattctgctggaaattaaatacattcaaacaagaacagagatccattagcaaaatgtttaaaaataatatcacagggttaccaggggtatgacaaaaatggacacttccatacacactaggtgaatatattggtgaaaatagttcagataaacatacaaccatgtatgtaaaagtatttatcatcaatgcattatttgtagtagcaaaaacaacaagcagccttggaaaccagttaatgtcctcagcagggaattaataatattattgtatattcatgaaattgacaccatgtggccacacaaatgcattacacaggcctctatgtaacataggatattcattagagaattgtttttcaagaggacaaagtactttcatttttgcctagaaaatgggggaagacaaaaatgcgcttctctctaggttgtgtgattttaggttatcctaagtttcatccttacgtgctcctga

SEQ ID NO: 628 - DNA, 133 bp, Homo sapiens
tacggaggggcattcctgctaatccagaatctgcatgtcaggacattctggaagccttttgctttgcactaaagtcaacctcaaaaattaatatcccacaatcacatatagcagaaacgcagagcaaagagtt

SEQ ID NO: 629 - DNA, 95 bp, Homo sapiens
attgctggcaattcctggtcatgctggtgcatttcctcttggagtcagacatgtgggttctgtgatgattctctgagtccaggatttatccagcc

SEQ ID NO: 630 - DNA, 36 bp, Homo sapiens
ttagttgaaaaatggagagatcagcttagtaaaaga

SEQ ID NO: 631 - DNA, 77 bp, Homo sapiens
gttcgtaagaagaactcgctgaaggactgcgtggcagtggctgggcccctcggggtcacacactttctgatcctgag

SEQ ID NO: 632 - DNA, 278 bp, Homo sapiens
catgggtggtgcatctgaccctatcccaacatgccttaggacgctcatctccttgactgtctgccatcccctcccaaaactaagtggaggctctgtcttttcctcctagtttgaggttctcttctcccagtgtctaaaatgatcaatatgcctagagtagatgctgctgaagaggcaaagtagtaatcctgccacctggaagcaaaggctgtgggttggagggggaagcgggtgtgagggctgatgataagccctaggaggctcctgagtcatattcc

SEQ ID NO: 633 - DNA, 29 bp, Homo sapiens
atggagaccacgcctactgacattcatcc

SEQ ID NO: 634 - DNA, 273 bp, Homo sapiens
gttaggctcagcttattattatgtgggggctcagcgtctatacccacctgaagctgggctgtccatgaggcttcagttcactaaccagatgtgcatgaaacagatacaaaaaggggaagcctttagggccaaaaaatagacctaggtttgtattactatttcagcttaatcgtgtataccttgtgtttcctcggccaacaatggctaattatggtaaatactatttagaattatgtgctatgtactaagtgtttgacatatggtatctcattt

SEQ ID NO: 635 - DNA, 223 bp, Homo sapiens
tttgacactttgctgcacttggagctgtgggccattgtgcacgtgcctggtggacagtcctgaccctcgctgtctgataaaaaagcactggccacatggccgctgggaaatttgaatgtggccagtctgaatttagatgtgatgtgtgagctacaaactagatcttaaaaaactaatgcaaaaaacgtaaaaatatgagtaacgatttcttatggcccacatg

SEQ ID NO: 636 - DNA, 157 bp, Homo sapiens
aactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgacc

SEQ ID NO: 637 - DNA, 39 bp, Homo sapiens
atgttgcagcgggacccaagtcgcagagcagacagcaat

SEQ ID NO: 638 - DNA, 978 bp, Homo sapiens
cctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgttta

SEQ ID NO: 639 - DNA, 165 bp, Homo sapiens
ttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtc

SEQ ID NO: 640 - DNA, 271 bp, Homo sapiens
ggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaagagccgtctcctgtcctcctgttccccagggcagggagccccaggacaacaccagacttcagctgtactgtggg

SEQ ID NO: 641 - DNA, 84 bp, Homo sapiens
ctcagaagacaacctggatgtgaccgacaacttctttgtgatggatctgaacagcctcccttggttctagcagaaggacttacc

SEQ ID NO: 642 - DNA, 115 bp, Homo sapiens
ttctgagtatgacgagtgcacgatgatggaccactgtcatggggaacacagtgcggcatcacggcacacagactggcatcgcctgggcgtgcgctgctccatgtttctcagaaaa

SEQ ID NO: 643 - DNA, 181 bp, Homo sapiens
gactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtatt

SEQ ID NO: 644 - DNA, 168 bp, Homo sapiens
ggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaaca

SEQ ID NO: 645 - DNA, 293 bp, Homo sapiens
tggtagtaaggagcacaaagacgtttttgctttattctgcaaaagtgaacaagttgaagacttttgtatttttgactttgctagtttgtggcagagtggagaggacgggtggatatttcaaatttttttagtatagcgtatcgcaagggtttgacacggctgccagcgactctaggcttccagtctgtgtttggtttttattcttatcattattatgattgttattatattattattttattttagttgttgtgctaaactcaataatgctgttctaactacagtgctcaata

SEQ ID NO: 646 - DNA, 112 bp, Homo sapiens
tactcaactgctctctcggcacagagcccctggcgagcgcacccagctgtgcttagcgctgctgcttccaacacgccaaagagctcatcttgccatagtgggtttaatgtcc

SEQ ID NO: 647 - DNA, 88 bp, Homo sapiens
tatgtaggggtttggagcaaccaactgtccaggcactgctttcctcagacaaccgtgtcaaactgattttcaagcctgactaacttgt

SEQ ID NO: 648 - DNA, 2245 bp, Homo sapiens
gcccatctgagctcttacctgtgttcacacctttgatccattccctcccatctggatttttttgctattttcccttcactctccagagtccagggctctctcctttgctcccacatagagataatactcaggtcaggaagacagattcctgtttataaaaaaagagaaccaaggtgtactgtggcacctttaaaactcaagccctgggctgggtgcagtggcccaggcctgtaatcccagcactttgggatgccgaggcaggcagatcacttgaggtcaggagttcgagaccagcctggccaacgtggcaatatgctgtctctactaaaaatataaaaattagccaggtttggtggtggacgcctgtaatcccagctccctgggagtctgaggcaggagaatcacttgaacccgggaggtggcggttgcaatgagctgagatagcaccactgcactctagcctgggtgacagagcgaggctccgtcaaagtgaaagaaaagaaagagagagagaaagggaggaaggaaagagagaaagagaaagaaagtcagtccatggtttccaaaacatacttctgtttccattaatttattaggaatgctcttccatctggctgttgatctgtgtcctgtgtaacatcctttataacaaatggtacacctcagtaaattgtttctccaagttgtgtaaatcactctagcaatagcaaattctgggggcagttttgtgcaactgagccctcagcctcctgtgagatctaatgctaactccctataaatggtgtcaaattgagttcaattagagaacacccagtttttatctgatgaaaaatagcttgttggtgggaagtaatccccacacattttgatgaccggagatgaggcattctgtgttgagcattcactattgtgttgattgtgagtagaaaaaacactttggtttttcctcctatcttatacactcacacaccctaccccatcccagaagtgaagatagtgacccatacctgaatgagtcaagtcactgcctgccgtctggcagaataaggacagcaaatggaagctaacctctgataccaagaattaggaaatgcacatgccttatagacagttttccaattctcatcttcatctgtatattttaaacaaatgtgatgtttattatagagaaattaatcataatatccaatcaattcatcattcatctggattgagtgtccccctctttcctcattactgtgtgtttctctacctacctctcattctcaccttcttttcctagctttttttttctctttatttttcccctaggattctcctcatttcaagcccttcttccttctcctgctcttccctctattccttctcttccacttgttctgctcctttctcacttctttcacctcttattcttctttctgcccaatatttgtctccaattttcatatagttctgcctctttcttccccccgtctctgctgccccctagcttcccctgttaaatcccctcttccctgctatatccacctgtcccctctctggcatccccagatcccagttctccccaggctgtggttctccctgtgctctccttatcactggctgcccctcttgctctcccagcaccatgctgctctgtctgccctggctccaaatccctccttctctccccaactctccatctgaggagcctccccttttctgcccctctccctatcttgctgaactttatctctctagaaacccagtttttctctaaatttctctagttgcttttctccccctgctcctttctcagcatcttcatgcactgtctctgcaaatccctcatccaccatctactttgccatctgttttgttttgttttttgttttttgagatggagttttgctcgtcgcccaggctggagtgcaatggtgcgatcttggctcaccgcaacctccgcctcccgggtaaaagcgattctcctgcctcagtctccagagtagctgggattacaggcattcgccaccatgcctggctaattttgtattttttagagacagggtttctccatgttggtcaggctggtctcaaaactcctgacctcaggtgatctgcccgcctcagcctcccaaagtgctggaattacaggcgtgagccatcgcacccagctgccgtctgtttatgggtctccttcattcttctttcccatttcaccatttttctatttcctctcctccacacattcatagggaggggactg

SEQ ID NO: 649 - DNA, 32 bp, Homo sapiens
cttcctgacagcgagataggagaggaccccag

SEQ ID NO: 650 - DNA, 42 bp, Homo sapiens
atgccagggagtgccgcattgcttagcgaccccgcctctggg

SEQ ID NO: 651 - DNA, 206 bp, Homo sapiens
tgctaacccacgatcaaggtcatggggtcagatagttattcagtgtggcagagactctttccttgcccatcagaatggagggaaaagaatattacacagaaatcaaagaagagcttggaaggacacgtatttcacaaatgcattgatgagtaagagagaaaacttatccaaggcagtgacaagagactcctgagacaactggcaca

SEQ ID NO: 652 - DNA, 38 bp, Homo sapiens
ggccggtgagctgcggagagctcatggaaggcgagtgg

SEQ ID NO: 653 - DNA, 68 bp, Homo sapiens
ggcacgctggggattcctgccagaattctggaagcttgggccccatcaaggcggtctcttgcccctga

SEQ ID NO: 654 - DNA, 579 bp, Homo sapiens
gacggtcaatattagcccttctgccaacatctggcaatgtgaggctggggtggacgttggcctgatgttgccaggagtaggatgctgatgctgccagagagtaggtgggctccaaaccccaggcttctcacttgcttactaagcacagcagtctgaagcttgggacctggcagtgcgtctttggagaaggcaaaaaagccacagcagcaacacttaggagcaagacccttcccgctctccaccctatttcctcccctgaagaagagcaacagctcaagctctagcatggcacagaacgctaggttgggccaggcaagcagccatggtggggccaggtgaagcaatgtgggtctcagcaaggaacccctctgaaggtggcagtggctcccagggctgctgcacactggacaccacaactttggcatcagctgcatggtgagctgcagagtggtcagaggggctggggccctgccaagagagcaaggccagacctgcccagcgggaggcaggaaggccctgatccagcaaggagaagtagaggaagtccacagccacctctgttactcatcgctactggga

SEQ ID NO: 655 - DNA, 437 bp, Homo sapiens
gccatgtcactagaagcgcagtttaagaaaaggcatggtgacccatgaccagaggggatcctatggttatgtgtgccaggctggctggcaggaactggggtggctatcaatattggatggcgaggacagcgtggcactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatg

SEQ ID NO: 656 - DNA, 96 bp, Homo sapiens
gtgataagtgcctgtacagaggtgtggcagactgcatgtaaaaatttgggctggcagatagatgattctgttcaggacgctttgcactggaagaag

SEQ ID NO: 657 - DNA, 66 bp, Homo sapiens
tcatccattccactagacgccttaaaaaagataacctctggccgtggagagatttgcttagaagtt

SEQ ID NO: 658 - DNA, 493 bp, Homo sapiens
agggaaagagcctccacgactcctccagacgctcagtccagggccgccagggtcagccaccctccccgctgtctctatctgtggccctgccaccagtcactcaacccgactttttggtctagagtaagagcagcagctgtaccccaatggcacagcaaagcaaatccccctacaggcaccatgcaaggccagcacaggcagctcagtgaaggcaacagactccagtgcaggtccacaagggccccctgcgggagcgcctgtctgcaggatgcggggcagagggaactgaattggaagccaaaggaagagggcagctgggagcaggagcccctagcccttttcagaatagggcaaaggtactcagaacttctgactctgaggaagaggtacaagacctcctttcactgcagaagtatcccaggacttaagccatgggaagaattcacaaccttgaagtcagaagtgaaataaactgtgtggtgtccaatgaagg

SEQ ID NO: 659 - DNA, 266 bp, Homo sapiens
tggaggggaccgtatcctaactatattaacttccaattttcatcgaaagcccacctgtctaagaagagctcctagacattccctttccccttcaacttggaggaattgggaatgacaaagagaaattaatcaaaagaagaattaatctctccaatcagccttggcattttctttctatctttgatatgttgttttttacagtgtcttggttttcagaataagctgtttgtaactacttcctccactatattgtgagcctctggagg

SEQ ID NO: 660 - DNA, 242 bp, Homo sapiens
tcactgatggtgacactacttgtaattactgtattttttggcagaacactcagatgaacagattcctatgctgtggacttttatcattctttttgatggctgatagtagaaagcacacagtaggtactccataaatgtaagactatggcagctgtctagtacaagtgcttctcactgattcttggttaccaggaaaaccagaaagcccgtcacttgccttgcctgcaaaggcgagcctaaag

SEQ ID NO: 661 - DNA, 50 bp, Homo sapiens
agggtagaataacatggaaagcagcttttattcactccaaggacagctaa

SEQ ID NO: 662 - DNA, 105 bp, Homo sapiens
taccactactacgagcccaaggggccggacgaatgtgtcacctacatccagaatgagcacagtcgcaagggcaaccaccaccgcttcatcaccgagaaaagggtc

SEQ ID NO: 663 - DNA, 336 bp, Homo sapiens
agtggcgtggtcagtcaccattgcacgctagccacaggactattctccacagagtccttccctctgtcccctgctgcagaggtgcctggtgatgacagccagcctgtaggccttgtgctaaagtgtcccttgtatctgctcagcactctgcaagataagtgccactgccatcctcacttccaggtggggaaactgaggcactggaaggggaaggaactcccacagctaggtagtggcagcttggcaatggcgcctccccgtgtgcacacaagcctgggaagggccaggcaccaggaccacattccttccaattacagtggccttccaacggtcagg

SEQ ID NO: 664 - DNA, 34 bp, Homo sapiens
gaaccaaatgatgaccaccaacgtctggctaaaa

SEQ ID NO: 665 - DNA, 91 bp, Homo sapiens
acggagagaagggtaacaccaggctgggtcggagaccggcggaggcgaggaaatcctaagagcgtgaccgttgatgatgcagggaaccgtc

SEQ ID NO: 666 - DNA, 76 bp, Homo sapiens
tttctaacgggaaagcggccgtgcagcgcagctccagatttctaaaagaaggcaacaacctcagcaggaagcttcc

SEQ ID NO: 667 - DNA, 298 bp, Homo sapiens
agtgtcacatagcaggcttaatagctaaacatctgcagctattgtgttccgtattatctcatttactgtcttttactatatgctttttcatgacatccagtaaaaggataacaaatgaaacattgtttcttatacctaaaattgcctattaattagctaattcctaaaattcctaattacaatatgaattttttttaagagacaggttgtcactctgccacccaggcttgggtacagctggcacaaccgtagctcaccgcagccttgaactactgggctcctgccctagcctactgat

SEQ ID NO: 668 - DNA, 403 bp, Homo sapiens
acatgcctttctagcggcagcctcagctccacctggaaacttgttagaaatgcaaattctcaggccctgcctttggcctactgaattagaaacttgaggtggggcccagcagcctgtgtctgtggaactatccgggtgatgccaatacacactaaagttttagaggccctggtctagagagagagagtatggagtgagaagaattttggtctagagttgaaccttgagaaggtttgacttttaaagactgggaagtgaaggatgactttgcaaaggaggttggaagtagtgtttagagggtagaaggaaaatccaggaaccaagagaagagagcaaagtagggagttacttgttgctgacatattaggctaagatgatgcatgcacaatgttctctgggttta

SEQ ID NO: 669 - DNA, 172 bp, Homo sapiens
ttctgggttcgaagcagctggacgtggaagggcgaggttcagaggccacacctgtgctcggggagctgctctggaagacggcactgagcgcctggcgccggccacgccccgtgtgctcatttcattacccactttcacggccggtgcccaatgggacgttgagctgctgttt

SEQ ID NO: 670 - DNA, 299 bp, Homo sapiens
ggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttca

SEQ ID NO: 671 - DNA, 68 bp, Homo sapiens
gcacgctggaagatagatgttgaacagtttgccagattcattttgagaaatcacggattgggagatta

SEQ ID NO: 672 - DNA, 549 bp, Homo sapiens
gggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcatgctaccttacgcctccccggccaaattccctcctctcctccggggggcaaggatggagtctgctgcagacccattggatttgctg

SEQ ID NO: 673 - DNA, 29 bp, Homo sapiens
aacagtgctgtgccaaaaacctgtggatt

SEQ ID NO: 674 - DNA, 89 bp, Homo sapiens
tcctcatcaaagaagatcaattgaatgctgcacagaaaggaacgaatgtaataaagacctacaccctacactgcctccattgaaaaaca

SEQ ID NO: 675 - DNA, 237 bp, Homo sapiens
gagatcttcacacatgttaaagaagcttgaaaacaatgaagaaaaacccaggggagaccgttagagagagggaaagacagagatgagagtggtagggaaaaacagtgagggatcagagcagcaccctgagagcgcacctggacatcagccattacacgtgagggggaggaacttttctgagtttccctaaaaggcttaaagtaaggggttgttgggtggaccacacatgacatatta

SEQ ID NO: 676 - DNA, 121 bp, Homo sapiens
acaaccattgctgacccaggcttgaggaagcggcagctggatcccagaaaggatgtggtcctgctactgccgctgttcctcaacatgactcaccctgtgatgcaacagttcgtcctggcag

SEQ ID NO: 677 - DNA, 93 bp, Homo sapiens
ggaacattcctttccacatcgcctgagtctgacagcccggatcaaaaacaagcaggctttgtgtcaagacgtggcacgtgtcagagaatttga

SEQ ID NO: 678 - DNA, 42 bp, Homo sapiens
aaggatctgatggaagcacgtcatctgatactacctcaaata

SEQ ID NO: 679 - DNA, 141 bp, Homo sapiens
agagctcccgcgtgaggctgctgcccctcctgggcgccgccctgctgctgatgctacctctgttgggtacccgtgcccaggaggacgccgagctccagccccgagccctggacatctactctgccgtggatgatgcctccc

SEQ ID NO: 680 - DNA, 467 bp, Homo sapiens
cctgtgagatccgaccatcccattaactttgaagtttctcttgattaatagaagaaaaaaggggagggtgaagaaaaggaggaacatgctaaaaaccttatgacaatcatccaaatgtgaggaaagaacaaccgattcaccaactccactttttctattttacaactttctacatctcactcttgattttggccttcctggctgaaacagcctggcagtccctagagcccctgagaagagccctggttctccaaaagacagaggaggagaagccctgcaggatgcgctgaccacttcccagagaactgacagtccgtgctcccaaaagtttgaaccaacagcctaatgtgaaaagaaactgcactgaaaggtaaaggaggaaatggtgatgaactgggcttatgtgagaatgtctatattttcataacacagccccagaatctttctctcagttacagcctcaggca

SEQ ID NO: 681 - DNA, 65 bp, Homo sapiens
tgctggttggactttgagcagggcttcctctggagcttcttgggacctgtgaccttcatcatttt

SEQ ID NO: 682 - DNA, 404 bp, Homo sapiens
agcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaagga

SEQ ID NO: 683 - DNA, 131 bp, Homo sapiens
ccaccatgctatgactggacatctgattgaatctcaaactcaccctcagcgcccagcaccgccagattcccgcaggcacctccagaggggcctgtgtccacctccgtcggcaccaggtggctgctttagag

SEQ ID NO: 684 - DNA, 76 bp, Homo sapiens
ttggggttgcagaggctatagcctccatgggggtcttcatctgcatgggcttctggctcccgtctgctttgggttt

SEQ ID NO: 685 - DNA, 283 bp, Homo sapiens
gcctgtccatttttaagcctccaggaaacccaggctgcagcttccaactatgccacagagcagagtttttcctgtgccaagagggctctgatgagaagacctggttgctcccttctggagaaacagaggattgcctgtcaacagatgggctacaattgcttctctttggagaaccaagagactcccagtcaacaggtgggctccatgtgctcttctctggagaaacaagggattcccagtcaacaggtgggttcccagtgctcctatctggtcgcaggtactg

SEQ ID NO: 686 - DNA, 40 bp, Homo sapiens
agctggaaaacctggtcgtcctggtgagcgtgggcctcct

SEQ ID NO: 687 - DNA, 307 bp, Homo sapiens
gaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattg

SEQ ID NO: 688 - DNA, 185 bp, Homo sapiens
agaaaaccaagccgagtcagaaggtccagggaagaggctcacacggatgccggcagcagagacaagcaaggcagaaggaaagcaccctgagaagacaggaaagaaagaatgcagcactggttaccaggatgaaagcccagaggccagaggaatgcttaaaacacatcattgtagtgctggatcca

SEQ ID NO: 689 - DNA, 58 bp, Homo sapiens
cccacgtgctcaagttgtttccagatacagaggctgggttcggcgactgagaaggccc

SEQ ID NO: 690 - DNA, 30 bp, Homo sapiens
ctggcaaggcataccgcctgacctgcacac

SEQ ID NO: 691 - DNA, 154 bp, Homo sapiens
gcaccaccattgatcagctttatatggcacccactgtatacaacagacagacaaagacagacagacagagcacacaccacttctaagctcaacactgctcaccaactagaagcacctcggttaagcacatgtgagacactcttgcataggaaag

SEQ ID NO: 692 - DNA, 50 bp, Homo sapiens
agaagctgcccttggctgctcgtagcgccgggccttctctcctcgtcatc

SEQ ID NO: 693 - DNA, 248 bp, Homo sapiens
gccagtatatgtgtcccaatttttcctttaatgtcaggtgtccctttaatctaaatccagttttgtctgacagagctctcccatagtatccttgatactgatatacatccaggacttgttgaaaactgttacaaatcaagctgtgtatcttcagacttgtcaaatctatcccatgattaaataattctgcttgtgagatctgcttggactctgtatgattttcctgatcttgataccctgtgaggaac

SEQ ID NO: 694 - DNA, 314 bp, Homo sapiens
gaattcaaggatgttccagtccctggaacatggtatagtatttgcatataacctatgtgcatcctcccgtacacttgaatctctacactataatacctaatacaatgtaaatcattgttatactgtatgcttggggaataatgacaagaaaaaattgtacatgttcagtacagatgcagttaaataatttttctattcctggttggttgaattcatggatgtagaacccatagatatggagggctgacttgactgtatagtgcattggcttttcaaacagtaaatctgcaaaatctaacttgggtctgttatgc

SEQ ID NO: 695 - DNA, 377 bp, Homo sapiens
ctccctgaggttccgttttacacatgatccaacgttaactacctttttttctgtatgctttccaaagtccttttttttcccttaatgttgaattaaaatacttgctcatagttgatttaccattcctacaaaagaggcagaaactttgagcaatctaggttttttttttttttaagttttttctttcttcctctcctgaatacactccccaaaacacccctttccagttacaattagcatcgtgatccaagcagatgccacatggaagaggaatcgccatttactcagaaaaaatgtcccttacaggaaccggcagcagctaggcagtcaccggcccgcctccatccaaaatcacgctcgcgtgcttcggaagcatc

SEQ ID NO: 696 - DNA, 87 bp, Homo sapiens
tcaagatggttctcacataaaaggcctgcttattaatttcatccatcacaattggccatcacttttgaagcatggttttcttgaaga

SEQ ID NO: 697 - DNA, 590 bp, Homo sapiens
atccatggatctgctgccaggttcagtgactggaatgcacttgccccagcgggttcaagttctttgtagaaacagacccctcaaagatgacagcagctggcttcctccagaagtgtccttcaacactgtctttcagtactaagtgaccagtagaagttactccataaagaccatagccaggaatgaattatggggcttcctgcatatcaaatggttacctagggaaggcatatggtaaactagttaagcacagaggttctggaatcagactgcctaggtccaaatcctggctttacaacttactagctatgtgaccttaggtgatataacctctttacgcctcagttttcttacctacaaagcaggagaaataatagtaattagctcaaagggttgctataagaatcaaagaaaatcatgcaagcaaagcacttactacagtgcctggcacatagtaagctcttataacagttttctggtattattcttattaagccattttgtattatatccataaatgtagattcataaaatacataaaaatacaacttggtagaatttgtcttggttggcagcagttgaagcttctc

SEQ ID NO: 698 - DNA, 195 bp, Homo sapiens
tccatgtaagagaacactggtacacaagacaaaccatcaaatttgtgattttttttttttgggaaaaccatattatatgataaattaaaattttgaatagtttttgtttactgacctgggactaagtatcctgggttttgcaaaatatggaggatctgtttaccttatcgctaatgggtacagcagagagtggct

SEQ ID NO: 699 - DNA, 32 bp, Homo sapiens
gcgacactaacaggtgaagatctcgggagacc

SEQ ID NO: 700 - DNA, 107 bp, Homo sapiens
gcatgtatatccatcatcgaaatacagtactcataaaagaaacctttattaacttatgtctaagtaatggattctgtgttcccagaccactcgacccggagttaaat

SEQ ID NO: 701 - DNA, 791 bp, Homo sapiens
tagagatcgtcctgagtgccaagcacgtttataagtagggcgtgtattccagtcctttctgtcattctgtgtgtgtgtgtgtgtgcacttatgtgtatgggtccatatgtacgtgtgtatataatatatattgtatgtgataatatgatcgtattctataaatacatatacacacgatactcctttccagaagttcctggggctccgtgttgcagttcaggactccttgcttcttggaccctactatttatcctggactagcttgggttggtgatcatgtctcctcttgtcaggctacagagtggtggaagaggacacacacacatctcctccatgttcctgccacagggccccttccttaagtaatgacttatctccttccagttgccacctgttggagccaagaatgtattagtttgtggtgacactgggttagctcagcatggatttcccttatccgatgatttttctacatttacttggccaatttggggaacagacctccactgtgattccatactctctctttgctttcactatcccagggatgggaggcggagggtagagatgaactcactgagcagccagagccaaatgcaatcggtacgaatcttagaaggaaggagggggagcccaggtatgagaaagaaaaaaccactaagaaaatacctccctgggaggatgagctggggccctttttcttttgctggatggttcctttatgcagcttggccctgtctaccgagatgcccatctcttcctgcctgctagcctgctagaccctcaaactg

SEQ ID NO: 702 - DNA, 89 bp, Homo sapiens
atcatcttacctcaggagtcattgaggggctgctcagcacccttggtccagccaccgtggccttattattttgctacggcctcaaaaga

SEQ ID NO: 703 - DNA, 119 bp, Homo sapiens
cctgcgtacagaacggcctcaggtaccatgaccgagacgtgtggaaacccgagccctgccggatctgcgtctgcgacaacggcaaggtgttgtgcgatgacgtgatctgtgacgagacc

SEQ ID NO: 704 - DNA, 250 bp, Homo sapiens
cacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaattt

SEQ ID NO: 705 - DNA, 32 bp, Homo sapiens
gtgcgtagattgatgacatggtcccaggtgac

SEQ ID NO: 706 - DNA, 100 bp, Homo sapiens
gggcccactggcgacagcccagagtccactggagcaccccatctgccgcaggacagctcgcagccctgtggcagctttgctgaccgcctatcacctggga

SEQ ID NO: 707 - DNA, 355 bp, Homo sapiens
cctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcag

SEQ ID NO: 708 - DNA, 386 bp, Homo sapiens
gggcatctctgaacttccaatctgaagtagccagccagtcaccagcacatcaccaacttgccattatcactgacctcttatttgtttgtttctcccagcaaaatctaagctctgtcaggacagggattttctctctcttgtccattaccatatccttagagctcagaaggggtgtctggcccaggtgctcaatgactgtttgttcaatgaaagaatgaacaaatgaatcacacaaaaggagagaggaaaatactatttcccattaaaatgaagaaagagtttttattagaagggaaggccacagcagccctctactaccctcttttgactaaacttccaggaaattcattactaagttttgggcttcagtaagtcagagtcaattt

SEQ ID NO: 709 - DNA, 81 bp, Homo sapiens
cagaacaagtgcatctgctggcagccagcttaaggagttagcagccctcaattccaataacgaacgtgtaaatcagaattc

SEQ ID NO: 710 - DNA, 178 bp, Homo sapiens
cagatacaggggacacaaacagctctgtgtttatgaactacaaccagttgttgacttttgtttcaagtggctccccttccccagtgctgtgtggacgatggactgaagaggagaaggctgggagcaagggaccagtaagctgttgcagcagtgcaggtgagatatgaggcctcaactc

SEQ ID NO: 711 - DNA, 109 bp, Homo sapiens
ttgagccaatagctgatgactactctgttattgatctctcagtgttaccacttgctgagtgttggacctctgtcatcacggcaaagtacaagatgcaccagagtcatca

SEQ ID NO: 712 - DNA, 31 bp, Homo sapiens
agccagcctttgccacgctgggactccagct

SEQ ID NO: 713 - DNA, 30 bp, Homo sapiens
attcaaacagacctcgtcattcctggtgtg

SEQ ID NO: 714 - DNA, 83 bp, Homo sapiens
cccctcgtcccttgctgctgagtgaaattctgctccctgctcccagctcattttcatcccgtcccacaagctcccaggtatat

SEQ ID NO: 715 - DNA, 71 bp, Homo sapiens
gctgaggatcgtgaccagcacctataaggatgggaagggcgccagatacaaccttgccatcgaggagcact

SEQ ID NO: 716 - DNA, 91 bp, Homo sapiens
aaagtgtcggaaggtgtacgggatggagaaccgagacatgtggtgtaccgcctgccgctggaagaaggcctgccagaggttcctcgactga

SEQ ID NO: 717 - DNA, 147 bp, Homo sapiens
tccgatgtcatcagtcctttcaaagcagacaggttccaagccttcttctacgcagcacttgatggaagagagcccgctcactcctcccccaatcacagcaattcttttcttagtcatggtctcccgagatcttcacctgttagtgtc

SEQ ID NO: 718 - DNA, 211 bp, Homo sapiens
ccagggtgaacactgtggtgcactccgggatgttcggctgcaaatagagaagacagggcagcagctagagaagacccaaggccagaagtgctgtgtggatgttttgactctgtttgtttatgggtggaaggcactggagccaccgaagtggaggaagaatgaagtgagaaaggagagtaccgatggagtcagggtccctagaatccagaat

SEQ ID NO: 719 - DNA, 274 bp, Homo sapiens
ccacggcctctgtctcttagggcgactgggcgcggaagaaaagctggagagcccctgcggggtggcaggaggagggtgcctgagtcccgcgagaggcccgggcgaggaagatgcgcagcctgctgatccgcgtcccgcccggcgccagggaccctcagagggaggagagctcaaagacctcgccccgcgccttcgcgaggaccaacccagtccccgcgcctgccccagagcggcttagaaactcagggcacagtgagagcgcagggcgcctccc

SEQ ID NO: 720 - DNA, 281 bp, Homo sapiens
acagctcggttgtagtgcacaattaaaatcacactaacttcatctgaagtgtcattctacagttttatttacacaaccagtgaagggcatgttctagaataccagctttaatccttttcaaacattaatataagaagccaaattgtaatgatacagcaaaatgaggccactggtattaatacaggtagcaaaggtccacatccaggtggtactgacatcagggaaatttccaaaaccagttgctgctgcctaagagtggttgccactgacgaaagcttgaa

SEQ ID NO: 721 - DNA, 353 bp, Homo sapiens
gccagatggggatgttcctgatctctgctagaccatcaagcatctgacggtttttctttctagagatgggcttggggtctcatgccttggctttggtgggcttctgcttcctcaggaactcacactacctgtacataccctgggactcaccagaaagctttaggctctgtttgattggtccattctatccttgactgttttcatatactcaagtggttgattttgccaatgggcctaagccatgtcagtcttaggggaagtttttgttttttcctttatagtgggtctaattttcctaactgcatttagcaaatagcaattcctggggccactgttggtctgaccctgattta

SEQ ID NO: 722 - DNA, 146 bp, Homo sapiens
tggccaagcaacatctcgagacctctctgtcctgggactgtctcctcaaattcagagccggtcagcattgactgggtgacctgtataccagggagaatgcttttacacacgcgcggagcccccctaggagactgccgattttatgt

SEQ ID NO: 723 - DNA, 87 bp, Homo sapiens
ctctttgacacatggtgctgctacaccgcccttcatggcaggtctgctacttctgaatgggacatacccttccaccgatgcattata

SEQ ID NO: 724 - DNA, 144 bp, Homo sapiens
tccaggtaagccttggcccgctgcacgtagactggttctgcctcctacttctgcttggtgttctgggcttccgggaccaaggggactcaggctgggatttctttgttgaattcaatgtagtcctttccatcataggcattcttc

SEQ ID NO: 725 - DNA, 87 bp, Homo sapiens
aatctcaatgctaggggaaataacccaccttcagaccatctcggaagatctaaaaagcctgaccatggaccctcacaaactgccctc

SEQ ID NO: 726 - DNA, 198 bp, Homo sapiens
gatccagattgaaacccaccagctatacaaaagacacttgagtcatggaaatgtggttagagactgggcattggatcttcaggaattatcaatttgaagggggagttgggaagtgataatagactgtgtttatatgagaaaattatccataatttttagaaatgcaaactgaaataggctaaaacgacatgtggtctg

SEQ ID NO: 727 - DNA, 57 bp, Homo sapiens
tatccatgtgcctctgttgatcgtcttggactcctatatgagagtcgcgagtgtgca

SEQ ID NO: 728 - DNA, 37 bp, Homo sapiens
ccagcggttcctccagtgacgctgaacttgaccagat

SEQ ID NO: 729 - DNA, 176 bp, Homo sapiens
ctggtttttagcctgtcgtggaagtgctgggacagaagcagccccttcttctctcactccccggctgcccctcctagcccctcttcagggggtccccatgtctcagcccgagggagaagttggctctggccagagccacgctcacactcccacaggatgccgcaagtcccaggcct

SEQ ID NO: 730 - DNA, 83 bp, Homo sapiens
cttggttatgttggatctgtttcccttttttgtgttgttccaagtgagattggaagaaaagataatgtaagagttggatggca

SEQ ID NO: 731 - DNA, 372 bp, Homo sapiens
agaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttc

SEQ ID NO: 732 - DNA, 237 bp, Homo sapiens
gctgagctcttagccactacccttggctgcttcctaactcagaggtattctgaacaaaaaaggttttgtgcacagatgcctttaggaaacactgggctaaacaaaggtaagtggctttcttgactgcaggacttctagagcttcatttgccacagtggtttaagtgcaaagttaggggcattggatgtactgttgcctagactttgtggccaccggaccatcttgtgaaccaaatga

SEQ ID NO: 733 - DNA, 301 bp, Homo sapiens
gcctcctgaggtgaatctagatgtctcaggtacaaagaggttttaatttcacagcatctccaacagtgcactttgggtgatgtggaccattctgtattgagcagaaattttctaatggaaggaaggttcctctgcagaacaactacagaggattttcacttaacactgcagcagttctggatgaatctggtcatgattctcagtctcccaaggggctcaggggcccacaaggcaggaacatcctttgggggtttgtgctgctgtcatacggttcctgtgttcagtccctagctaccatgtg

SEQ ID NO: 734 - DNA, 79 bp, Homo sapiens
tggcaacagtaatacaagacggatcatgagaggtgccacaggagtcgtaagaaaataaagttcaataggaagtgagagg

SEQ ID NO: 735 - DNA, 52 bp, Homo sapiens
tgtgcaaagtacgttcccgagaattcagtgagttcttctggacaaaataaac

SEQ ID NO: 736 - DNA, 257 bp, Homo sapiens
gccattttcatagcgggagtggacaggttttcaaaaaattcaaagtaagtgctatagttattttcttttctttttcttttttttttttatcacactcctaaaaccaagtagaaggggaatgctgggctttgtactggataatgtgagtccccatgtaaattgtgagcgattgcaaagtacggaaaggtttattacctaaggtgagccctcccagagctcccggagtataaaagcattaagcgcatgttctaacaaac

SEQ ID NO: 737 - DNA, 69 bp, Homo sapiens
gtagcattcaataaaaccgcacaagtcctctccaaatgggaccctgtcgtcctgaagaaccggcaggca

SEQ ID NO: 738 - DNA, 65 bp, Homo sapiens
tgtattccacaatggccgcgccattttacgttcccatcagcagtgcccattggtcccagtttctc

SEQ ID NO: 739 - DNA, 32 bp, Homo sapiens
ttactcgccttcaggtgtcatgttcttgttcc

SEQ ID NO: 740 - DNA, 399 bp, Homo sapiens
gtgcataacacacctgggtaacttttatagagatggggtttcaccatgttggccaggctggtctcaaactcctgacctcaggtgatctgcctgcctcggcctcccaaagtgctgggattacaggcgtgagacaccacacccagccataactaagcattatgttttctaaaacttctaagatcctccctaaacccgtctggagacatgggttttagcccagactctgcctcaaactcattgtagctcccagcacattacccagttgctctgggccttggtgttatgctctgggaagtagatgttgatgctgtggccttagtgccttctggccccagcattccatgggcctgtgatcttgaccaacctgagaaaacagtaacagcccatccactggaaata

SEQ ID NO: 741 - DNA, 88 bp, Homo sapiens
tcagattggggaacgctaccttgccagcggttgtccttcttccagcagtaggcaaataacagtgaccaacgcgatcctgggcattctg

SEQ ID NO: 742 - DNA, 248 bp, Homo sapiens
ttggaagctctacttgtagcacaacttggttaacttctcttgtgaatttcatgttttccctggaacttgggctaggtcccatggcccctggtgtgtgtgtctttttttctgttaatattttcttattttgttcaacttgcggagagattttctctacttttatcttctaaccccttctgttttcttgaattttaaaattttctgctgtcatttaaaaaaattctccaccagcggcagtggcttacatc

SEQ ID NO: 743 - DNA, 413 bp, Homo sapiens
aggcaccatccatatcacaacgctgcctaaaaattgtatttatattgcatgcaaatatttgacaactccatcacaaacaataaaagatcggggagagaaaagccatttagcctgataaagtacatctcaatttagctagcagatcagtacccacaggaataatctggaaggcatgttccctaccccctccaccttctgttatttgcatttctagcagtgatcactgaagcatcaggatttgtggggattcacaagtaacatcatgatgggaggaggcagccctgcctccgatgatgagctgaaaatagctgaagatggtaaaaccaagagcaaagcaacccggctcatagccgaaatttcatctcctcctcagcctctcacagagaagccaggaagagtctgattggcttgca

SEQ ID NO: 744 - DNA, 37 bp, Homo sapiens
cctcaggaacaggaaccttctcttgcccaacaaagtc

SEQ ID NO: 745 - DNA, 95 bp, Homo sapiens
ctcccggcgatgttgaaagtacgggacccgcggccctggctcctcttcctgctgcacaacgtgggcctgctgggcggctggaccgtcctgctgct

SEQ ID NO: 746 - DNA, 54 bp, Homo sapiens
tgagacaggcgaacagggcgacagaggcataaagggtcaccgtggcttctctgg

SEQ ID NO: 747 - DNA, 37 bp, Homo sapiens
ggctttgtgacaaccaggacgactgtggcgatggctc

SEQ ID NO: 748 - DNA, 86 bp, Homo sapiens
gggaagctgcgcctccgcaaacgctcagaagcagcttcgccagacagccgcaacgtacatgttgactgcccgaggcggaagtcgat

SEQ ID NO: 749 - DNA, 215 bp, Homo sapiens
caataatgttgggagatgggacctaataagaggtgatttggtcatggtcatgagggctctgcccaaataaatgaattaatttcattattggaagaaatagttttgttataaaaatgaatttggcttattttgcacatgtgcatgtgttctcctacccttccaacatgagatgacacagcaagaaggccctcaccagatgtgagcgccttgacttt

SEQ ID NO: 750 - DNA, 296 bp, Homo sapiens
gaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctagtctgcaactgcagg

SEQ ID NO: 751 - DNA, 36 bp, Homo sapiens
tgaaacatattgtacgcaccaggaactacttgctgg

SEQ ID NO: 752 - DNA, 30 bp, Homo sapiens
gacaagctgttaagattccggaagcaaaga

SEQ ID NO: 753 - DNA, 92 bp, Homo sapiens
gcccgggtagaaaagcatgcactgagccccctgcccctagactgcgagtactgtacaaatccaacacttgaaaccgacacgcacacgcgcgg

SEQ ID NO: 754 - DNA, 108 bp, Homo sapiens
ctgcattccagcgttaaacaacaccccaggaagaaagactcacaacctctggcccctggagcatcccccaaacagtcacccccaacaaccgagagtcctggaacgtga

SEQ ID NO: 755 - DNA, 82 bp, Homo sapiens
cggggtctgcgaggaggacgttcatgggcgagtgtgtggtggtgggtgaactgcggcagaacccgagattaacagctggaac

SEQ ID NO: 756 - DNA, 42 bp, Homo sapiens
gggtggtcctctaaagaattgcaacttctggcccttgaaaaa

SEQ ID NO: 757 - DNA, 219 bp, Homo sapiens
ccagaggtgtatgtgaccaggcccagctagaggaggcagcttcaggctagcaccccaacaggaaagaacagtccttaggcccggtggcttcagcaattaaatcagggttgcatctcatcatgagtggatcccacagccaggcagattgatagctgtgatcgtcctgacgtgttatgtgtccctctctggatgcaggggccatagtactgacctcactga

SEQ ID NO: 758 - DNA, 111 bp, Homo sapiens
tcaaagaagacgacattcccagatagaaaaggaagcaaacgttttttgagaatggagacaaaaactattttgcacatcataatttttccattagcaagcacaatgccagaa

SEQ ID NO: 759 - DNA, 48 bp, Homo sapiens
cagtcgggctgggagaaacatatggtgccacaaatatcccttttccaa

SEQ ID NO: 760 - DNA, 38 bp, Homo sapiens
ggaagttagcttttggtccaccagcgagtttgaatgga

SEQ ID NO: 761 - DNA, 231 bp, Homo sapiens
ctgaggatctcttagcgtgtttagactagaggctgataactggtgctcaaagtcagccaatgggcatgttttatttggtttcacaggagttaaaaacctaatttaaaaagtcaacattttaaaaagagagttttcacatgaaaattcagttggaagatcagctgtgttcagttggctttcctacaaggtgtctcattagctggagtggaggagcacctgactctatgtatg

SEQ ID NO: 762 - DNA, 557 bp, Homo sapiens
gctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctgg

SEQ ID NO: 763 - DNA, 207 bp, Homo sapiens
ctgagctgttggaggacttattaccattccctggagaagaaggaaagtcatcttcggttgtgttgccctccctgtgaaatccagacccagacgtcctctggcgggaggagctaccattacttggtccgtttgtcagacgactgcagtctttacttgtggcctctgactgttctacaggttcagaagctgtagtcctgctggtacttg

SEQ ID NO: 764 - DNA, 114 bp, Homo sapiens
tgcagacaccagatgcgagacaataggaagagctgactgggtggttcaggacctgccactggggacagtttcttcgtccacctttggtcttgggtccatgcttccatgtccttc

SEQ ID NO: 765 - DNA, 83 bp, Homo sapiens
ctccttcagctttgccgccttagtgatgtaaggctgcttttcactgtcatttaaattattccacatctcacccagcttttttg

SEQ ID NO: 766 - DNA, 271 bp, Homo sapiens
ttgcactcaagtcagcgtaaacctctttgcctttctctctctctctttttttttgtttgtttctttgaaatgtccttgtgccaagtacgagatctattgttggaagtctttggtatatgcaaatgaaaggagaggtgcaacaacttagtttaattataaaagttccaaagtttgttttttaaaaacattattcgaggtttctctttaatgcattttgcgtgtttgctgacttgagcatttttgattagttcgtgcatggagatttgtttga

SEQ ID NO: 767 - DNA, 140 bp, Homo sapiens
ctgggagctaagctttctcagcctccacgtaatgacattttggtctgagtaactctgttgtggtgtgcagtcctgtacattccaggatgtttagcagcatttccagcttctactagatgtcagtagcaaaccatccttcc

SEQ ID NO: 768 - DNA, 312 bp, Homo sapiens
tcagaacctacagccgtgcgtgggaaccctcagagctcaccgtgctcccatgagcaggcagtaggagcacccccttcagaacctaggaaccctcagagctcaccatgctcccatgagcaggcagtaggagcacccccttcagaacctacagccatgcccgggaaccctcagagctcaccgtgctcccatgagcaggcagtaggagcacccccttcagaacctatagccgtgccccggaaccctcagagctcaccgtgctcccagctcctccacgagggcagagtcctctgtctgcatccagctgaaccctga

SEQ ID NO: 769 - DNA, 78 bp, Homo sapiens
tgtaaagtggggcacctgccgtgctctgatcacgtggcccacggagctgggtcctgcagtcactccctgccatggcgc

SEQ ID NO: 770 - DNA, 109 bp, Homo sapiens
ctccactgggcaggggtttcttctattttaggggccattaactttattaccacagtcattaacataaaacccccagccatatcaaacaccacttttcatctgatcagtc

SEQ ID NO: 771 - DNA, 72 bp, Homo sapiens
ctgtccgattccacattgtcttacactgaaacggaggctaccaactccctcatcactgctccgggtgaattc

SEQ ID NO: 772 - DNA, 43 bp, Homo sapiens
atatgtggacattggagtcttagcgtctgatttacaaagagtg

SEQ ID NO: 773 - DNA, 87 bp, Homo sapiens
gctgcccaaacctgggacctattacctcccctgggaggttagtgcaggccaagttcctgatgggagcacgctgagaacatttggcag

SEQ ID NO: 774 - DNA, 99 bp, Homo sapiens
aggacgggactccaggtccacattacaccagacaccaggacgagcaccgacccagcccctgtggtgccctggagcactgagatcttgtgccagctctaa

SEQ ID NO: 775 - DNA, 102 bp, Homo sapiens
aagaacccggtgcatataggcgatccgctgagggaagcacggaatggggaagtgggtagaggcaggtaatgagaccagctgaatccgggtcttggtgtttta

SEQ ID NO: 776 - DNA, 48 bp, Homo sapiens
gccacgctgtgtgcaaccactgccacccatcaagggtatattgagcac

SEQ ID NO: 777 - DNA, 135 bp, Homo sapiens
ttttggaacctatagaacacaacaaagagagaattttactgcatgtacttttaaataaattcattcattcattctttaagtaatttttaaaaagaagattattagattgtctccctcactcactactaagaatgg

SEQ ID NO: 778 - DNA, 31 bp, Homo sapiens
cccagccacctcatggcctcgcaggaggctc

SEQ ID NO: 779 - DNA, 96 bp, Homo sapiens
ggtggcagttctgccgctgccactgcctgtgcctaagacttctcccgtggtccctcagctggtggacagaaacacattctccacggaagaagtgcc

SEQ ID NO: 780 - DNA, 72 bp, Homo sapiens
atccaaatgcaatgccacaggctgtttgaggatggtggaggtggtggtggcggaagtgggggtggtggtcga

SEQ ID NO: 781 - DNA, 207 bp, Homo sapiens
tgggacaaacagcagtacctccctcatcaggtactgtgggattaaatgagattatatatatatatgctgggctccaaacagagcctgatatatagcaagcattcagtgaatcttaaccagcatcattgtgattccacacaggagcccatctgcttgaggaatttagctgtaaaaataaaagtttgaacactactggatgggatgatc

SEQ ID NO: 782 - DNA, 133 bp, Homo sapiens
ttccactcaggttgccggtgatacagacactcctttcagagccaggaaccactctttttttctgtctctcctctgttctgaaatttagcatctgggcttgtttgatatccttgttagaggtcaagagcaggtt

SEQ ID NO: 783 - DNA, 521 bp, Homo sapiens
atgatattgatctctggcttacctaagcatactgcgtgatagtaattatattgaaagacatttttcaattaagttaggaaaagagtaaatcatgatcaatgaaaactaaatttgaactattaagaagcctatggggagcagtttatgtttctgatatgatttatgctctaaaatttcactagtttcctttacactcttaacttttcatagttaggcctaaactaaaccaaatattcatgtgctttattattcttccttgcttctcagtatcactttccttatcacctaaaaggcattattaaaaatcaaaaaacaaaaaatctgcacatctattatagtctgaatgtatgtttttagagaatagaaataagaaaaaagggaggtatttaaaatgttgaagtaagttgtggcagacctggaagacaatgcatggctaaagtacagaattactttctctgaaaaatctttaaaacaaggaaaccagttcatgtctgttcagggaccttgccaatttcttcatc

SEQ ID NO: 784 - DNA, 264 bp, Homo sapiens
tttctccctcctcgacagcatcatgatcctccaccagagcatcatgatcctccaccgtatgtccctgctccggctctacccctctcccccactctctccaaccaacccacttctgactctgagtcctctctgcctcctcccctcacccgctctcgggcccaatgtgctcagcaaccagctcccttgcttcctctccgggaagtagcgggagttgaggggatcgtccatgtccacgtccctttctccttctacgatctcttacag

SEQ ID NO: 785 - DNA, 600 bp, Homo sapiens
ctggaagcctcttacagtgctggtacaaactagaatacacaaaggaagggatcattttatacgtgttactgtgctacttgctctatctacttagtgttccatacatgtaattacctattccatcctatcccaaagtactgaaaatctccattctactttctctgtctgtgaatttgactattcatagagagagagatatgtggaagtatgcatgtgtccttccatgtctggcttatttcacttagaacgttttcaaggtttatccatgtggtagcatgtatcaggaactcattgtttttgtgtctgaataaatttccactgtatggttaaagcatactttgtttatccatttttatgttgataaacatgggttgtttccacagtaataatttgactgctatcaataaggctgctgtggatgtggtatgtctatgtctgtgtgagtccctgctttcaattcttttggatatatgtatccctaggagtgtaattgctggttcacagaataattggtgtaaacctttttcaggaacaggtatattgctttacaaagtggctacaatgttttacattctctccagcaatgcataagggtttcta

SEQ ID NO: 786 - DNA, 377 bp, Homo sapiens
agcagctgtttccaggtcatattcagctgttttattcctaaagatataacagaaatctttaagctacattttggtgtgtctgtgtaggctggcataggacagggtggtgtttagtgggaaatatctgtgaaccaattattgcagttgacttaaggctccagaaatttccagaatccatgttcatattctaaagacgtgcacatttatgtatgctccatctttagattttcactttcttttttcctctccacttcttgctctatcctgctccatttttaaggttttaaaggacttgggcatgtgtcgttgcttgataatggtggcggtagtgattgtgctgtgtacctaaaaccagtatcaagggctgttgtgtaaca

SEQ ID NO: 787 - DNA, 59 bp, Homo sapiens
ggcagccggaggaaacctcactccccagactctgcaggaaacttacgtgcaagtctttt

SEQ ID NO: 788 - DNA, 114 bp, Homo sapiens
ccaatgaagagtattaccagctgctgatgtccagcgagggtcacccctgtggagcagacgtgccctcctacaccgtggaggagatggagagcgttacctctgagcacattgtga

SEQ ID NO: 789 - DNA, 45 bp, Homo sapiens
tctgactacttaactcttctccgtggtgctctgacaaacttgcct

SEQ ID NO: 790 - DNA, 797 bp, Homo sapiens
gcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtataga

SEQ ID NO: 791 - DNA, 137 bp, Homo sapiens
ttattgtgatgggagatagtcgtcctgcacttctgtagattacaggccagcaggtggaagcctgggctgtggaatcagattgggtttgagtcccaggtctgcttcttggccactgggcatgcaaggccttcattttc

SEQ ID NO: 792 - DNA, 78 bp, Homo sapiens
ttacgccctcccaattgctacataatcatgacctattccaagtttattcaagcagccaagtcaggatgtctccccagc

SEQ ID NO: 793 - DNA, 258 bp, Homo sapiens
atggagctccactaccttgctaagaagagcaaccaggcagacctctgtgatgccagggactggagttcaagagggctgcctggtgaccaggcagatacagcagccacaagagctgctctctgctgtcagaaacagtgtgcatccaccccaagagcaaccgagatggaagggtctaaacttagttcttctccagcatccccctcctcctctctgcaaaacagtactcttcagccagatgcctttccaccaggacttctc

SEQ ID NO: 794 - DNA, 97 bp, Homo sapiens
cacacatgtgcctgcgtgggctctgccttgtcttcgcggaagcattcctgatggaacacccactggccagccaggccatggcttctcccgaccctct

SEQ ID NO: 795 - DNA, 72 bp, Homo sapiens
actgattcgtcctgagagaaacacattggttgtgagttttgtggacctggaacaatttaaccagcaactttc

SEQ ID NO: 796 - DNA, 83 bp, Homo sapiens
gccagggaagtggagttggagccacagatggtttaatgggagtctttctcagcctccacgatagcaagaggacctccctggag

SEQ ID NO: 797 - DNA, 66 bp, Homo sapiens
ctcctctgagccaagaacgacagtgatgccagtgtctccactgctgcaaaggttctcattttgttc

SEQ ID NO: 798 - DNA, 51 bp, Homo sapiens
tccaactcctaccttgggagagaatgacagtgaaccaaacaagtaaagtat

SEQ ID NO: 799 - DNA, 261 bp, Homo sapiens
cccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatga

SEQ ID NO: 800 - DNA, 50 bp, Homo sapiens
caaagactctacctgctgttgttaagcatgaggtttatccccagactaca

SEQ ID NO: 801 - DNA, 109 bp, Homo sapiens
atgctattaaatccggtcaacggtgtgtgtggagcctgctccatggccagcaccctattgggtcatcaccccgaccatggaggacagagggtgccatccctagagatgc

SEQ ID NO: 802 - DNA, 119 bp, Homo sapiens
ctaaatcacactcctgtatcaaccatgagttcttctcagcctgtgtcacgaccattgcaacccatacaaccagcaccgcctcttcaaccatctggggtgccaacaagtggaccatctca

SEQ ID NO: 803 - DNA, 81 bp, Homo sapiens
tcttgccctgggtagcaatcaggtggttcatgagtggtgccaaccagttacatttcctgatatgcaatacagctggcagca

SEQ ID NO: 804 - DNA, 340 bp, Homo sapiens
ctttgcagggtatgttcccggcccacagggggctctccatggatctgaggagactggcagggcaggatcggaatcggcaccctggagaagctgtcgttggagacggccttggcgagacagtgtgttgcagctccagctctgtccgctgggttcagccccctcaccttacctcagtcactaacctctgtgcgctcagcgttctcagctgttaagtggacgtaacacaggttgagcatcctttatccaaaatgcttgggaccagaagtgtttccagtgttggatgttttcacatttgggaacatttgcagatacataatgaagtagcttgtggatggaccca

SEQ ID NO: 805 - DNA, 315 bp, Homo sapiens
ctattctggtctcaatggcttcgggaaacacacatatacacatacaccatgcccttgaactcaaagcaaactacgctctcagggaaatacaaatatcacgttcttatagctgtaaagtatagcttagctatttatagaagactatgaggtactgttgtgagttatttgcttatcctgttttattctgaaaaatgaaagtgctcaatagaatttttaacgttggcaacaccataaggatttcttatgttaagtcccaacttggggttgcaaaatcattttttcccttaatacctgggtgttgtattagatctcata

SEQ ID NO: 806 - DNA, 146 bp, Homo sapiens
agctcctccgtattgtcctgccgggaggacaggatcaagtggtggcccgtcaggcacagggtgccctcgacagccgggtagaaaggccggtgcagcaccacattgtccacccgcggggtcttaatcagctccgcaaactccatgct

SEQ ID NO: 807 - DNA, 118 bp, Homo sapiens
atggatcggattctggtgcagagaggaaggttgagagaaatggaggaaggtgaaaccaacaagaagtgtccggacacgctagcaggatttcagcatacagagctaacaagatgcgggg

SEQ ID NO: 808 - DNA, 674 bp, Homo sapiens
ctcccacggtgctggtattagaatcatgagccaccgtgcccagcaaaagatgattttaaacatttatttaggtgggtaggcaacattctaagataataccctggattaccagtctgttgcacacgtgctgtgtcatactttcctcttgagtgtaaaaaaaatgtgtgactgtggtgggaaatcacttatgaaattaggttactcatccgtagactttgtgtttatcaaaatggagattatcctgattgtgctaaacttaatcagaggtgcttttaagagaaagagacacatcacagaaaaacacccctgctggcctgaaagtaagtgacttctaggtagaacatgttgtaagctgcttatggtggccacatggcgggaaaaatgtttgtatcttgccatcatttctgcctcctccatgttgcttccagtaaggaacataagaggattctatggcagagggaaaaaaaagggaatctcattcattcaagaaataatcacctctcatctgggatagcttaagagaaacaggagaccacaacaggtccacattaatgggaggaaaaaggtaacctgggtaaaagtgctcactggcattatggaacagtatttagtaagctgtagtgaatgatcagcctctgggataccaatagtctaccaacaaggctgaactcatt

SEQ ID NO: 809 - DNA, 173 bp, Homo sapiens
aatgagtaaggttgatagtgtggtagagatagctggggagaggtagagggtggcataaaaatgggaatgagaataagagtgagtataaaagtaaagagtagaacttcatcagggtgaaagaattggagggtcccctgccagcaaagatcatctatgcactctaagagggagtt

SEQ ID NO: 810 - DNA, 408 bp, Homo sapiens
ccgtgaagcctgcagtacgtgtgccgtgaggctcatagttgatgagggactttccctgctccaccgtcactcccccaactctgcccgcctctgtccccgcctcagtccccgcctccatccccgcctctgtcccctggccttggcggctatttttgccacctgccttgggtgcccaggagtcccctactgctgtgggctggggttgggggcacagcagccccaagcctgagaggctggagcccatggctagtggctcatccccactgcattctccccctgacacagagaaggggccttggtatttatatttaagaaatgaagataatattaataatgatggaaggaagactgggttgcagggactgtggtctctcctggggcccgggacccgcctggtctttcagccat

SEQ ID NO: 811 - DNA, 277 bp, Homo sapiens
ttctggtccgtatgacttttgctttaagactattgctcaagctattttgtaagtttggggttctcccacacaagtacattgactaagcattggttaaaaggctaggcacctgagtaccacttacatgttttactttccaagttccaacctaactacttataaacttgaaagtagttatgaattgtgggttacctatagtcaaatagtagggtttttttttttttcagtcaattggaaatgaaagggcaggtattggcaaggcttcgggactaattta

SEQ ID NO: 812 - DNA, 68 bp, Homo sapiens
agagagctatccaaaatcacgaatgcctagggctcagagctacccagataatcatcaggaattttcag

SEQ ID NO: 813 - DNA, 374 bp, Homo sapiens
cgtcgacagggcaggatcttaggcccctactgccacatatggaacaagctccagttccagtctatcacccagcacctggccagcctctgttagcaatactgctgactgaagaagaacaagttagaacagctcaaagactaagccttctacagtgtctgcctgaagaagtttatgaccctggaagagataaatcagaagaggagatgccagagtgtgtgatctgtttactggaatttgtttgtggggaccccattcgatgtctgccatgcaaacacttctttcaccttgactgcatagacacatggctgctgcgatctttcacatgtccctactgccgggggccagtggatgcagcgctgtctacatccttggga

SEQ ID NO: 814 - DNA, 89 bp, Homo sapiens
gaaagcaggaggcttgaaaacctccagtatcataattgctctgacagatggcaagttggacggtctggtgccatcatatgcagagaaag

SEQ ID NO: 815 - DNA, 115 bp, Homo sapiens
caaaccagaagatgccatggactttggcatctcccttctcttctatggcctctactatggagttctggaacgggactttgcagaaatgtgtgcagactacatggcatctaccata

SEQ ID NO: 816 - DNA, 101 bp, Homo sapiens
ggggcagcagtaccatctacatctccttcacccctatggtgctcagccctgagatcctgcacaaggtggagtgtactggctacgccctgggtttcatgagc

SEQ ID NO: 817 - DNA, 211 bp, Homo sapiens
ggaataagacacattgtacccactaagtaatttttcatcctccactcccctctctcccccatgcttgtgaactcttttctattgtatatttttagcagactatcagcacaagtcttacagatagtattgtgtataccaatagctattttgcctagacggattcctcctggaagttcatacctttatttctgcctattctgtgccctctgag

SEQ ID NO: 818 - DNA, 105 bp, Homo sapiens
tcagcctcagagaagacgagttccctgagccccggcttaaacacctccaacggggatggctctgaaacagaaaccacctctgccatcctcgcctcagtcaaagaa

SEQ ID NO: 819 - DNA, 458 bp, Homo sapiens
ccgccttttgacagacagggaaactgaggcacgctggcccctctcggcggccccccgggaaggacgccccgggccgtggggccgagctgccccgccctccggcctcgcgggcctccgccctcggattggcggccgcgcggtgggaggaggagccttggcccagccgctcggccagaagcttctagcatgtctggggctgcccctccccgggcgcctcctcccgcggccccgagcagccccggggtgcggtgcatgggggtgggggagccgggggtgacgacggggacggcgcggcggagcccgctgcggacccgggctcacctgggctcggccgccggggtccgcggggcggcgcctccggctcagctgcggggcgaggggttgtgaatgcaggagccgaccccgttcgtgggcttgggggctgggttgggataattcccgggaagtgatgacctggc

SEQ ID NO: 820 - DNA, 225 bp, Homo sapiens
tcagactgtggcttaatatacaataattttctcagaaaaatgaagctcttgcgaagaatggttgggcatatttcaccaaaatcaagtatttgtgtgtgtgttttttttttttggagtttgaatataatcctgtaagtagatgcttcaaaaccacttgaatcaccatggaaagcaaatctctttagttattctccatctaagcagcctttgccgtacagtttaatt

SEQ ID NO: 821 - DNA, 98 bp, Homo sapiens
caaacttgtggcttggtgatccaggggttggaaaagaggctgttcactgccttggtcaagaggagctgggatgtgctcgtcttcacaccaggaagaag

SEQ ID NO: 822 - DNA, 93 bp, Homo sapiens
atgctcaggtggagtttcatttctctgatctatgtgcttctccacttttgctcagccacactgaatttgcctattgtgtcctgaatatatttt

SEQ ID NO: 823 - DNA, 87 bp, Homo sapiens
tctgactgagtgtattgaatggccttctacggtactagtcatgtgtcagaccagacacctgatctcagtggatatgcctcctcaggc

SEQ ID NO: 824 - DNA, 79 bp, Homo sapiens
gaagacagttattcaaacggacctaaagcatatgatgctctgtgcaacactggccccgttcacaatgaatgcacttaca

SEQ ID NO: 825 - DNA, 101 bp, Homo sapiens
cacttattgctgaaaccaagagcacaattcccattgagagaaagatctctgtgctgtaaactaaaacaaattgtgcattccttccggggccatcgtctttg

SEQ ID NO: 826 - DNA, 112 bp, Homo sapiens
caaattaaatagacgtgagtggatggaaagacgtaccttattcttgcataagaagacaacggcatgaagacatcacagggaaggttaaggtaaacatgcagcctggaatagc

SEQ ID NO: 827 - DNA, 101 bp, Homo sapiens
agaccttccatcctgatctgactgcactaagcaattgctgacctgcatcattctggtgtggagcccccaggagacaagcaaagaatccttggccacaacta

SEQ ID NO: 828 - DNA, 156 bp, Homo sapiens
gctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagcc

SEQ ID NO: 829 - DNA, 107 bp, Homo sapiens
atcagcaaactcatgtttgactttcagaggaactcgacctcagatgatgactcaggctgtgctttggaagagtatgcctgggtcccgccgggtctgaagcctgaaca

SEQ ID NO: 830 - DNA, 119 bp, Homo sapiens
agcttctttggttacagggattttgtggacttttgtgagctggcagagcaggacagggtaacccacctggacatgagatcaagctcgctggtccctctcaatgctgtctgatgttgctg

SEQ ID NO: 831 - DNA, 158 bp, Homo sapiens
gatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcacttta

SEQ ID NO: 832 - DNA, 1199 bp, Homo sapiens
acccagccgcctttagatatttctaaaatggtgcagccactatgaaaaacagtttggcagttcctcaaaaaggtaaatgtggagttaccataggacccagcaatttcactcctaggtagtaggtttctctatgaaatcttccaagataaaaataaaaagaaaaacaaaaagaaaacttcatttgctctcctcgttcaccaaaataaaactcaaattccttagctgcctgccatacccagtcccctttcataatctagctctaacctatctctccagcctcatctccaatgtcctcctttcttcccccgcacagtgcaaacacacaatattgacattccagcctccagctactcactcttcccaaataggtccctgcttccaagtctcagcacctgtgcttcactctgctgcaataccttctcccccttcctggcttgtgagctattatttatcttgcaagacccagctccacaccctcaggcaagcttcatcactcttcactgtgctgctagagtaggccctcccttaaggctccaaagtcatcacttatatagtgtttgtcattaggcaaaagcctgttccactttcaccagcctgggaattccttaaggccatggaaaccctggggcctggcatatagtaggtgctcaagaatcatctgcagaagacaaggcttatacctgaaagacaggtacaaacataggcttaataggctctctagaaattatactgattgataccacaaactaatttgggggccagatataaagaaaccatcaatgagaatggtttccttcgtgtcaatgtaatagtgtattatgtgttttagggatacataaacaggaaccaaagcacactacttattatgacaaggcgcttataatgatttgcatttctctgcaaaactctttaggcatataattttgttaatttgtgacaaacctcaaaaacacacttaccaccaataccttgattgcaatatatactttcaaatcacacagaaatcaagttcctttcaaaggtttccaaaagagtctgaagtgcgttgttttgtttggtttgttttaaatttgggaatttaaatgcagatcataatttataatttaacccagacttaagggaagaataatttcacaaggatgttcaagaacctgacctagccttcttttgaatgttggcactgacaatgcgtgaccttg

SEQ ID NO: 833 - DNA, 54 bp, Homo sapiens
cgtgcagccatcgacagtgacgctgtaggtgaagcggctgttgccctcggcgcg

SEQ ID NO: 834 - DNA, 280 bp, Homo sapiens
cgaggtcgtgtcttttgcggaaacatggatggagctggaggctattatccttagcaaactaacgcaggaacagaaaaccaaataccgaatattctcacatacaggtgggagctaactgatgaacacaaagaaggaaacgagacactgggggtctactagagggtgaagggagggaggagagagaggatcagaagagataactattgggtactgggcttaaatacctgggtgatgaaataatctgtacaataaacccccgtgacagaagtttacccatgtg

SEQ ID NO: 835 - DNA, 142 bp, Homo sapiens
ctggtgaaacgtccagccttatggagtaggcccctgaggtatagaaatggttttgatggcataggatgtagccttgggaatgtcctggaagagtaggagcggccagttaggcattaacactcaggagtaaggagactgcatt

SEQ ID NO: 836 - DNA, 1064 bp, Homo sapiens
ggtgactgcctgtatcaaatctttactgcctttttcaaattcttaccatttttataaaaaggagtcacactactcaatctatacatcagtgttaaatatgatttttactaatttttttttttttttaccaacactatcttaaaaaatctgacagcatagagcagtgattaaaggcatttgcttcagggtcaaatatagttacactgctgttttttggacaatttgttattttgaaccattgtttcttacctttataaaatgagcataagataatgttcttttaaggtgagtatgagatacaaatgagaaaagcaataataataaagattcaacaatggaaactgctatttacattatgattgttataattagaaggacaaactgtaatttaacgttcctatagtaataaaatggcatctacagagcaaatctaaacagacttaatcttcatataacaattcatcccagataatttgaattgaccataataacatgtttgaaaggaggctgaaataaaacagggtttgctcttttcaactctttagccaagactttttttaaaaaaaactggtatataaatgctttgtatttcctttcaagtttgaagggaaaataaatataatacttaatagattttcaagtatctctttagacattctcttgtttaggcttgtactaatccattcattcagggtttgactgttgggtgaacttctttgccctattcccagctgtgagaggcaattctccaggtttctaagctttagacctacgcccttctctgatgaggttaattagggtttgggctgaaacccagattcctatatatgtggatagagtgatgtagaagtactttatgataataaatataaatgaaatttagattttaatttagaaatagaaaacatttaggcaactcactgaatcaaaaataaatatagacaaatttaattaatatatttatttattatattttcctgggttgggctttggcctctatttcatatattttgtttatttttcaggatgttctgggataatgtagtccaggttctagttctgcc

SEQ ID NO: 837 - DNA, 52 bp, Homo sapiens
ctccagcgccatctcggtggtgaagattctgcgagtactccgagtactgcgg

SEQ ID NO: 838 - DNA, 60 bp, Homo sapiens
cgtgaaccgcgggtacaggtgtcctgtctgcgctctctgccaagccggcttgcttcctga

SEQ ID NO: 839 - DNA, 97 bp, Homo sapiens
ctgcaccaccatccaaagtgataaaaactgtgacaatacctactcagccctaccaagatatagttactgcactgaaatgcagacgagaagacaaaga

SEQ ID NO: 840 - DNA, 213 bp, Homo sapiens
gtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgta

SEQ ID NO: 841 - DNA, 85 bp, Homo sapiens
gaagaagcccgcgagttactctctcatttcaaccatcagaacatggatgctcttctgaaagttacaaggaatacactagaggcca

SEQ ID NO: 842 - DNA, 230 bp, Homo sapiens
tgacagtgcccttggtagtactaactgcaaaagcccgattctgccggacagcagtgattcgacacttcacctgtgagtgcattgcactgctgagcatagcttgtggagacctgaccttcaacaactggctggggctggctatgtgtttggtcactgtaatctctgatatggccctgctggggacctcctacacccacatcatctatgctgccttccggatctcttcttgg

SEQ ID NO: 843 - DNA, 51 bp, Homo sapiens
agccatcctagaagggctcatgccagtctcttggttgcagagccccggctt

SEQ ID NO: 844 - DNA, 63 bp, Homo sapiens
agctgtggccggaaggaaagcttcagtgattcccgaagcaaagcagacagtcgagttcggagt

SEQ ID NO: 845 - DNA, 29 bp, Homo sapiens
agagaaaaataggctagctggagagttgc

SEQ ID NO: 846 - DNA, 175 bp, Homo sapiens
tttgtattcgttgctccctcagaggtggaggtgaggggaaagtgaagtgtagtggttccactctgatcacaaaataaactcctgggttgacgcctcacccgcggtttgatgttcagagcacacagcgcccgccgcctgagttagcctgaattagcagtcccgcagtaacagcagc

SEQ ID NO: 847 - DNA, 303 bp, Homo sapiens
tgcgtgcctagaggtcaagtgtaactggtgttcgtgagcacctcgtggttgcgggtctctaactctcgtgggtctctaagcgcacccgcggggctggagcggaggttcgtgtctctgggagggtcagtggtgtgactgaagctgggagttagctcgtgtctgtgggtgcctcggtgtgtgtctctggggctctgagtccctgtgcgtgcgtgtgtgtctgtgaacccgacaggaagctccccgagggcaggaatatgttttgctctctactcgatcccagcgactggcaacgagcgtttaata

SEQ ID NO: 848 - DNA, 54 bp, Homo sapiens
gtcttaaaggtgatcggggagcaattggctttcctggaagtcgaggactcccag

SEQ ID NO: 849 - DNA, 445 bp, Homo sapiens
aaacatctgttatcatgggctgggcacagtggctcatgcctgtaatcccagcactttgggaggccaaggtgggtggatcacgagatcaggagtttaagaccagcctggccaagatggtgaaaccctttctctactaaaaatacaaaaattagctgagcgtagtggcaggtgcctgtaatcccagctactcagaaggctaacgcagagaactgcttgaacccgggaggcagaggttgcagtgagccgagatcgcgctactgcactccaggctgggtgacagagtgagactctgtctcaaaaaaaaaaaaacaccaatatctgtcatcatgtaggcacagccaaggtgaactgaagcaggatacgaacactcagtacattcatgactatcttcatacattcctgaaatgatcctagagatcaccttgggaatagcaaagtggtcata

SEQ ID NO: 850 - DNA, 28 bp, Homo sapiens
gttgatatttccaagctgctgatgtccc

SEQ ID NO: 851 - DNA, 75 bp, Homo sapiens
tgagtgagcagcctgcggcagccctgactcactgcgggtcgtgccgtctgtgcagcactggggtacccaccaccc

SEQ ID NO: 852 - DNA, 140 bp, Homo sapiens
cccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgca

SEQ ID NO: 853 - DNA, 118 bp, Homo sapiens
gcttactgggcgctggtgggtgggtgcagggtcaccgctgccatctgtgcctgcctgtcccaggctcttgctccccatgctcctctgctgctctctgggtctggccattcctctccct

SEQ ID NO: 854 - DNA, 130 bp, Homo sapiens
agtttcgctacaggaggtgtctgcacggccctactgcagaaaagaccgggacgggaccagcctcagggcgactttaaactcaaaaggaaaagactcacggactcccacccggacgtctcaatttgctctg

SEQ ID NO: 855 - DNA, 77 bp, Homo sapiens
aaaaagcaggggtgctacagcaaagacactatcagatgacagatgtaggagagtggtcatgtcaagaagcaaaagga

SEQ ID NO: 856 - DNA, 200 bp, Homo sapiens
agtcctcccttagtttgattcttggcatccttcagaagaatcaaagcctgcctcagtttaaaaatcagatgaaatgtgaacagaaaggttttttggttctgaagacctgctgatcactcctggtctctgcctgagtgtgttaatgtcagaggtaaatccagtaccgctaaatttgtataatagtacgtgacctcttgtgc

SEQ ID NO: 857 - DNA, 29 bp, Homo sapiens
cagtcagtccagagcacatgagatcagct

SEQ ID NO: 858 - DNA, 59 bp, Homo sapiens
cccgttcatcggctgggcgctcgagacggcgcccccagatctcccaccgggcagtgtcc

SEQ ID NO: 859 - DNA, 84 bp, Homo sapiens
gaaacatggcttggatcattccgtctcccacctcagcccctccggagctgcctggacctcatcattccggagagtctaagtggc

SEQ ID NO: 860 - DNA, 48 bp, Homo sapiens
gtgctctcctctggttacaagctcaggccaactcctaaaagccaaact

SEQ ID NO: 861 - DNA, 106 bp, Homo sapiens
gccctgctgtaattgtgaatggacacatgcaacaagcccagccttaggagagtgtgatcatcaagggctcacacctctcaggaatgaagagttggttcacaccacc

SEQ ID NO: 862 - DNA, 160 bp, Homo sapiens
tccggctgcgcggtttgccgtcttcgtccctggccgcggcggctggcgactggcatcggggcgcccgggacccccagggcggcgacgctgccgccggtgccgccgagcctttgttccgccgccggggccggtttcacgcctgtcgccctcgcaagcagcc

SEQ ID NO: 863 - DNA, 41 bp, Homo sapiens
tgctttccctggcaaggtttgtggctccaaccttctgtcca

SEQ ID NO: 864 - DNA, 1103 bp, Homo sapiens
tcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaatgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagta

SEQ ID NO: 865 - DNA, 44 bp, Homo sapiens
gtccagcaagcagaaaggcatcctgagtcacgaagaggaggacg

SEQ ID NO: 866 - DNA, 57 bp, Homo sapiens
ccagaaacttcttacccgtattgagctgccagaagctgcaagtgctgttgcaagatg

SEQ ID NO: 867 - DNA, 181 bp, Homo sapiens
tggttatagatttcacttcctcataattttcattaagtttctgagccaactcaagcctctctgtttccatatgttccaatgtcaattctttgttctttaattcattctttaaattctctatttcattaatctttttctgcatctcactcatctcttcttgtacattaagaagttgttgctg

SEQ ID NO: 868 - DNA, 121 bp, Homo sapiens
caggaacagcggagaacagttcaggacaagaagaaaacagccgggcgcaccagtcgtagtaatccccccaaaccaaagggaaagcctcctgctcccaaaccagccagtcccaagaagaaca

SEQ ID NO: 869 - DNA, 69 bp, Homo sapiens
atgttctggttcctagagagcaagacatggtgcacagacctgtgggtgaaacccgatggagacccatgg

SEQ ID NO: 870 - DNA, 108 bp, Homo sapiens
gagtgggcccaaggaccctatggctcgcaagatgcgactgcggaggcgcaaggattcagcccaggatgaccaggccaagcaggtgctgaagggcatgtcagatgttgc

SEQ ID NO: 871 - DNA, 32 bp, Homo sapiens
tcttgagattcctctactctcgttatctgacc

SEQ ID NO: 872 - DNA, 176 bp, Homo sapiens
cctgccatttcctcgcatgtaattttttaacactcatatctcagtgggctcttagaggtaatccaaggtaagaaccacctttttagttaggtctgatggttagaaagcttgagttgaagcgtgcccttctggaattgccactttgggcccaattttgtctacacgggaactgctta

SEQ ID NO: 873 - DNA, 337 bp, Homo sapiens
gaggcaattttacacccatccgacgcctcacatttgaaaacccaatggcggtactgacaggcctggggcagcggacgctctcaggcattgctgaggagaagggaaagcagcttgagcgtttggaaagctgtctgtttcttagaaagttaagcatacactactctatggtctagcaaggccagtcctcaatatttaaccaaaaaattaaaaccaaaaacatgaatacggaaggactggaaggcatgattatgtgttatttatcatcgccccaaactgcgaacaattcaaatatctatgaacaggagaatggaggaacgccgtggagagtatttttaca

SEQ ID NO: 874 - DNA, 42 bp, Homo sapiens
ttcagctggtccagacgcagtggctctgacgttctctggcag

SEQ ID NO: 875 - DNA, 65 bp, Homo sapiens
atctatgatgctatcaatcctctactcagaaaaaaaaaaaaaaaatcaccgaaatggtgtctaca

SEQ ID NO: 876 - DNA, 54 bp, Homo sapiens
ctcgagtgggtcctgttggattgaagtctgacagtggtgattcccttcaacaaa

SEQ ID NO: 877 - DNA, 47 bp, Homo sapiens
tgggggattttgtgcgctaccactacaacggcacttttgaagatggc

SEQ ID NO: 878 - DNA, 397 bp, Homo sapiens
ggggagacttttccagctgggccaagggagtcagactctaagaacaatagatgttgcttttcccgtgtcatgtaaatttgttgcacttttttgggctgagctgttagaggggcttctccagaggctcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttcggagaccaa

SEQ ID NO: 879 - DNA, 94 bp, Homo sapiens
accgagaccctgatgggccagtgtctcgggtggggtctgtgcagcatactgaacacagcggcgatcctgagggacccgtgatgcttctagccca

SEQ ID NO: 880 - DNA, 309 bp, Homo sapiens
tgcctacactgagaactgaatgatgagtaggtattcactagacaaagaaaaaaaggaaagcgtgttctaacagatgcatgcaaaagtccttcagcagaaggcaacacgaggcaagaagcagcacagttggataggatgctggggaggccagtgggagccaggccatgcagacttgccctttatcataacagaactagggctgggcacagtggctcacacctgcaatctcagcactttgggaggccaaagcaggaggatcgcttgagcccaggagttcaagaccaccgtgagcaacataagacgaccctg

SEQ ID NO: 881 - DNA, 191 bp, Homo sapiens
gattagtttcagtggttctcatttcacttttatacgtaatttcttaactatattaagatagttgcaggcagtgtacctcaggttgactctgtacatctgaatagtgagtcactagtattttgcttcaagccttctgaaaatataaccatagttacctaagcacacagtgaatagtcacatggtagtacttg

SEQ ID NO: 882 - DNA, 41 bp, Homo sapiens
acaccttcgagcctatcaccagaagatcgacagcaacctag

SEQ ID NO: 883 - DNA, 112 bp, Homo sapiens
ttcctttacatgctccctcgggtgaagcaaggcagatggagaaggctttagcagacagcgtgggcatgtttccaagccctcaggctgctgagcaacaatgccgatgccagca

SEQ ID NO: 884 - DNA, 178 bp, Homo sapiens
cctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtg

SEQ ID NO: 885 - DNA, 40 bp, Homo sapiens
tcttgggtggatctttgtccctatctacatcaagtcgggg

SEQ ID NO: 886 - DNA, 208 bp, Homo sapiens
gctgactttactatcaaaagcacttgaaatttaaaaattatgtccatgattaaaaacttgcagaagttgcccagcaactattttcattccccagaggcagagagtataatggaaaggaggaatttggggtgagatgtctttcttgtgtttaaattttctactctgaacttggacaagtcacttatcttcctaaatcccaattcctcat

SEQ ID NO: 887 - DNA, 33 bp, Homo sapiens
cgcagcctgtggcctccgagattggcttctctg

SEQ ID NO: 888 - DNA, 124 bp, Homo sapiens
tggcacaggtttgacactgcaggtcggaggaggaagacagtggctgcaaaggcaaaatcgggtgttattttcccaagagtcccttcagcgtgagtgccggggtcagctcgaactggagcctgta

SEQ ID NO: 889 - DNA, 49 bp, Homo sapiens
tgagatcgagaataacagaagcagcggagcattctggaaatattactat

SEQ ID NO: 890 - DNA, 57 bp, Homo sapiens
aaggggacttgagtgctggatttctggaggagatcagtggaaaattgagtgttggtc

SEQ ID NO: 891 - DNA, 42 bp, Homo sapiens
tctttgaacttgagattgaggatcggcccagtacagcaccac

SEQ ID NO: 892 - DNA, 265 bp, Homo sapiens
cttctgcccatagcggggtactctgacctcttctccctcttcccttctttgccacacatcagctcctctgggaagctgatttgctccagggacaggaggtgggggaaattgcctgttaaccttcccaacacatcacctcaagttaaaattggtggatttccagaatttgtataggatgggaatggggacgacacacttttgagctagtagcttctgctcgttttgttatcccgtaaatgttgtcttcccaaaaggtgattgattg

SEQ ID NO: 893 - DNA, 48 bp, Homo sapiens
taagaagaaacagtaataccagcagcagcatattggtggctggataca

SEQ ID NO: 894 - DNA, 33 bp, Homo sapiens
ccataatcaggcaacaaccaacttccatgactg

SEQ ID NO: 895 - DNA, 58 bp, Homo sapiens
gcaggccaacaacgatgtctgcgtgccccagagtctgataggcagcagcccgagccag

SEQ ID NO: 896 - DNA, 32 bp, Homo sapiens
agaggatgggaaagcactatggggagaccacc

SEQ ID NO: 897 - DNA, 101 bp, Homo sapiens
gggagaagacaagtagctctggttcagactgggccacagcccaggctctgtcactcagaagggccctcctcgaggagcaggagcaagctagtgggctgcca

SEQ ID NO: 898 - DNA, 186 bp, Homo sapiens
ctgctactgtggaataggtggaacatgtatagtgggaaccacaagctgtcactgccacattcttgcatgtctcaagaagctactggcaggcttcccctttttgccttattggccagaaaagtattgcatgcccgcgcctaagccaaccatgacaagggaatggtaggtaccatcatgattagctta

SEQ ID NO: 899 - DNA, 80 bp, Homo sapiens
aggcagcagatactcgggtgctaaaaatccctccaaacatctcaacattttttccccctcgggatcagtatggtgtcacg

SEQ ID NO: 900 - DNA, 401 bp, Homo sapiens
agagtcctgttataccgccactgggcaggtgatagtcgtagcagctaaagaatggggaacaactgggggtgctctgtggcgttgatgttaaagctacagagtcaggtttgacctcaaagcaatttcctaaattactaaatacacataactcttattgttcatgctttaatccatggtctttggcatattattggcctgttaaatgctaataaacctttgtttctcagcatgtagtttacatgatggggacttgattaagaaagtactttcaagcatcttatttcataggaaactttattagagataagataagacccattcaaatatgcattctcttaaaaatgggttgtgagttattctcagaattctctgctgtctgtcctttcctgtactccacttta

SEQ ID NO: 901 - DNA, 640 bp, Homo sapiens
tccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctc

SEQ ID NO: 902 - DNA, 71 bp, Homo sapiens
cacacgtgtggtaggatgcagagtgctctgggcaggccactcagaggcccaggtctgctccatggtcccag

SEQ ID NO: 903 - DNA, 182 bp, Homo sapiens
gcgccacctgtagcgagttatttaaggagaagagctgggcttatggaggaaccgtggaaagatcacaggctatcttcagagaagctgctggtggaattcccaagtccttactgggtttggggcttgattacccactcagtgcccagctggtcatcatcatgttggccaaccaccagagggga

SEQ ID NO: 904 - DNA, 129 bp, Homo sapiens
acaaagttttggacactaggcaggctggaattgaggtgttgcagctgtttactggaattgtctgggaaagcagaagccttcacactggggactttgagacctgtgagatatcatcatccctctaccaag

SEQ ID NO: 905 - DNA, 76 bp, Homo sapiens
ctgctggtggcttgggacatcagtggggccaagggttctctgtccctggttcaactgtgatttggctttcccgtgt

SEQ ID NO: 906 - DNA, 53 bp, Homo sapiens
ggcagagagcaagccgggaagttggtgaacttggaatttgatgagctccttgt

SEQ ID NO: 907 - DNA, 36 bp, Homo sapiens
tgtgatgtctttccccatccgtcataagggtcatgg

SEQ ID NO: 908 - DNA, 28 bp, Homo sapiens
atggtgctgctaatgtgtctagaattgg

SEQ ID NO: 909 - DNA, 95 bp, Homo sapiens
gaagccaagcatattcgaactccgaatccgctcgatcgccggggacctgccatctgggttcggttccccaaggtcgctgccgaccttagaccgcg

SEQ ID NO: 910 - DNA, 407 bp, Homo sapiens
ggcttcctatatctcccttcctggtcagcaatatagcccattctctggagcttcccgtggggatttttcttcccagtgaattcttcctattagttatctaagtggtttaactgttgaaatgttttccgtcatctttagatccttttgaaaccactttctctacctgcttcagttccatttgatgaccgccatcatctttgagattcccatccagaaccatgcatacctcttaggttctcacagccaggagctatttcctaagttgtctttctggtggaaagctcagctcctactaagcagtccttgcttcaaaatggctttgatgaatgacccaaaggagccaggccagtccctgagtcatcacagagcaccctaggtgagaaaccctgaagtgttctctgctgttg

SEQ ID NO: 911 - DNA, 74 bp, Homo sapiens
agatattgttgccaccttctccacactgctgtgggagtccatggcatcccgtttgaccctaggaaatgtacctg

SEQ ID NO: 912 - DNA, 137 bp, Homo sapiens
ttcaatccccgccaggctgactatgacaaggatgaggttggggaccgctgtgacaactgcccttacgtgcacaaccctgcccagatcgacacagacaacaatggagagggtgacgcctgctccgtggacattgatgg

SEQ ID NO: 913 - DNA, 75 bp, Homo sapiens
tttgctgcgaccaccttccatcataacctttgcactagtgattgtaccaaatggagaaaacgctttccggagacg

SEQ ID NO: 914 - DNA, 270 bp, Homo sapiens
gcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctcc

SEQ ID NO: 915 - DNA, 230 bp, Homo sapiens
cgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgt

SEQ ID NO: 916 - DNA, 134 bp, Homo sapiens
ttcgggagctctataagcagcggctggatgagtttgaaatgttggagagacatatcactcaggcccaagcacgggctattgcggaaaatgagcgggtcatgagccaggctggagtacaggacctcgagagcctt

SEQ ID NO: 917 - DNA, 269 bp, Homo sapiens
tccgacaaacttcgctgcggggtcaggcttatccagaaatcgtgcacagttctgtttgtccaatccctgcccttcagatgtttttaaggtttgggggccgtaggtcttcctgagataggagccctgcagcctgccctgccatcctagaggtgggagctgcagtgcacctggcagccaggccctggccagtcgagggtggggctgtgaggcagcagggagaccttcgtgctcccagtgagcggagccgactccactgctagcggactaga

SEQ ID NO: 918 - DNA, 375 bp, Homo sapiens
ggcccgtgatgtgcgcaatcatgtacgtgagcagggcgtagctggcgatgttgaaaggcacaccgaggcccatgtctcccgatctctggtacagctggcaggacagctcactgttcaccacatagaactggcagagggcatggcatggaggcagcgccatcagaggaagatctgaggaaccagcagaggaagataaggagggatggtggtttgaaagaccacagctaaaggcaaagtaaaacaggagagaaacagaagccaactcatatggtggagaccaggagagagagccactgggctgcagtgatgtccataacagcctctgcagcgatggcacggagctgagggagactatccatcggtgcaaggtttctg

SEQ ID NO: 919 - DNA, 68 bp, Homo sapiens
tgaggcttgttcagcagaacaggtgcaagccacattgttgccaagacctgcctgaagccggattctcc

SEQ ID NO: 920 - DNA, 227 bp, Homo sapiens
cttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattc

SEQ ID NO: 921 - DNA, 42 bp, Homo sapiens
gaggatcagggatgagaagaccaacgttaggaagtctgcact

SEQ ID NO: 922 - DNA, 94 bp, Homo sapiens
ttcccttcggggaacgtgcatctgtttttaggagcggtgcatgaaggagatgggtgtacgcgcgggcagagaggatgttgtagggccggcatgc

SEQ ID NO: 923 - DNA, 119 bp, Homo sapiens
cctggtacagtcgtggaggtccatatgggtgaaaagcccagaagtctacctgagctgaaagcactcccaaggagtttggttttgtttgggtttgttctaggtatggtcccagggatccc

SEQ ID NO: 924 - DNA, 79 bp, Homo sapiens
tcgatttgggggctcctatattgtccaggggttgaaatccattggggagagggacctcatctttcacaaaggccttcac

SEQ ID NO: 925 - DNA, 362 bp, Homo sapiens
tggcttatgcacagtattcccttcaactccatatacacataaatacaataagtaattacattttatatgtaaacgtcattctttttaaacaaacaagaaaaagcaatgtaatggcatgcccaattttcactccacataaagtctcatatatcaccaaactggtttcctctagtgggttagatgttcatctctgagttccattgatatttatcctctgaaggcacttgggtttggggttgctggcaggaggtgaagaaccatcagagttaaggtcaagggacaggaggtgctgctagagagagaagccacaaggaccacaatgaactgaggtgtctagggaccatggcatgcacagggcattg

SEQ ID NO: 926 - DNA, 83 bp, Homo sapiens
tgcctttaaaaagctgcgctagaggtttaggggggaagagtgggatagacggtgtgggagagttggtttccacgctcctgtag

SEQ ID NO: 927 - DNA, 380 bp, Homo sapiens
cggggatattcaggccaacactaggaaaccacagccaagtcaggcagggcttggggcggaactgctgacacctccaccctagccaatccaaggtgcacgcctgcctcatgcagcccagcgtgactcccgccattggcacactgtgcccatcacaggctggagctcctttcctccaccgtcttcccaactcctgccaaccagaacttaactactcctttggattctgcttttcacttgttcttcatcagactatggaagcttagacttcataatttggctgagacttcaaaaatagttttaaagaaagctattcccaccctgctaaagtaattacatgattctgcccccttaaacacccaaagccctaatctgtgttctca

SEQ ID NO: 928 - DNA, 77 bp, Homo sapiens
gggacctcaccacacccatacacggggacccaatgatggctcttgtggactatcacgatggcgtcatcgccagcacg

SEQ ID NO: 929 - DNA, 102 bp, Homo sapiens
gagggatacggggagcctccatctttggattcttttggtacaggaacaacatccctccaggtgacctccacctaccatggctctgtagacgccagctcctca

SEQ ID NO: 930 - DNA, 1381 bp, Homo sapiens
taggagagtccatcacagggcaatctgacctagtcatgaaggtcagcaaaggctctccaagtgaccatagaactgagaactacagggtaagcaggattaagtagaagaattggggaggaaaaaatgttcaggaagagagggaagggcacgcacagggcaagataaagttgggaagtaggcctgaccatgcagtgctcttgggcatgctgaagattttgattttgattcttagaggttctaagcaaggagcaggtgacaggatcagatttgtatttttaagagattattttggctgtggttacagaagatggaagcgggggatgggatgagcaagtgtgaaagccggaggcctgtgggaagccaatgtagatgtccaggaaattcatgatggaaccttggactggggaggtgatggggggaggggaggagtggatggacttgagggccatttaggagataaaatggacatgattgggccatgggttttgtgggaaggataagggtgagggagttatctaggatgacacccaggtttctggataaaactgttgccaggcaacagagagaaagccagaagggagtggggaaggggtgggacacattttcccttgcagttgtttttatgcccatgtttgcaaaataaagggtgttggaggtgtgggcgtgcacagctccctgactgcccacccaaggataagaagactggtttaagaagattgcatgttgcagggtaaagggagctaggtcttctactctgggctctgcatgcaggtaactgtgtgatttcactcccctggcccaggactctgaaacagacatccctccttgtctggcaatttcatggcaaaaagcagcctgagtcgtatttgtccactcatgctatttacaggactcctccttgggaagttatttcttgtagatccactttatccagagcctgaaggtgaaaaatcatcaagtctagaatgtgagatctgaaaggaatcacagagcccattttcccaatcttctaattttacactggggcagcccccgtgtctgacccatgtctctatgctactctactaccttgcctacaggaagagaggttaaggagtttgtccaaagccacaaagctattgggcataaggaggtgaccccacattccttttcttactttgggggtggggattcttctgcagcctgcagttatttcctaggacagtggggctaggtagagctgtggcgatgagctaagatcatagacacaggtgatgctgagcatctgggggaataattcatctgaagctgtgccctgctgagttggagtcctttctgactctttaaagatgcctcttgtcatgcacccagtcgtgactcctgaatatcctcctggggttgc

SEQ ID NO: 931 - DNA, 31 bp, Homo sapiens
ttccccatcgacgggaaggcttggactccaa

SEQ ID NO: 932 - DNA, 408 bp, Homo sapiens
ggaaaagtcagcctcttacacaaggttttgtatctatacttttactctgtcaattacagtggtattttaaatgcattgaatataattcattgaatgtctgtatctttctgcctcgatttaagtgatattaggttaaaaaaatatttacagttttcattctggtccaccttccctccttatccttatactgaatccatttctctacttttcaggtaagtgaaaggggtcacaaaatttttaggtttgtgtggagggtaaaaatgcatccagcaattctaagcacaacaattttctgtaaggccttctctgaaaaaagagaaggaattacttattaaaactaagcacacttagcaacttctttcccaatcctatctttattcgtttgcctggtgccaaatttttctggcc

SEQ ID NO: 933 - DNA, 81 bp, Homo sapiens
aaacacagtagagtctgcaaatttcatcagtcagaccaagatagttaccgtcctcgtagaggggtatgctggatttccaaa

SEQ ID NO: 934 - DNA, 85 bp, Homo sapiens
gcccgccggtggatgctccgcgcctgccctccgcagcctcgctcagcagtcctgcgttggggtctgcgccctaggatgcactgag

SEQ ID NO: 935 - DNA, 36 bp, Homo sapiens
acctaggtggccaggcaattgtgggaaatggaaaga

SEQ ID NO: 936 - DNA, 234 bp, Homo sapiens
atgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatca

SEQ ID NO: 937 - DNA, 81 bp, Homo sapiens
gcgcctcggcttcgcgctcgtgtagatcgttccctctctggttgcacgctggggatcccggacctcgattctgcgggcgag

SEQ ID NO: 938 - DNA, 181 bp, Homo sapiens
cagagctgaggcttaacccagggcctgcgccctccacggcctgcactgccccacctccagctccttgccctgttcctccctctgcaccggatcagcccccggactctgggtcacctccacaccagttgacagggccccccagtccccaccgccaaccacctggccggctacttgtcagaca

SEQ ID NO: 939 - DNA, 35 bp, Homo sapiens
agtggtcctcaagaatcgctggtccagccactcac

SEQ ID NO: 940 - DNA, 44 bp, Homo sapiens
tccagggcaaccgtggctttcgattgttactgtgggaactggag

SEQ ID NO: 941 - DNA, 96 bp, Homo sapiens
ttccaaggctcaatcaccaaaccatcaacagggaccccagtcacaagccaacacccattaaccccagtcagtgcccttttccacaaattctcccag

SEQ ID NO: 942 - DNA, 78 bp, Homo sapiens
ctggaactttgagccccaaacctggtgaccccacgagcacctcgcacttcttcacttttcctcggttttacatcacat

SEQ ID NO: 943 - DNA, 131 bp, Homo sapiens
attaggtgatggtagcggactagccgacggagggcaggcaggggagggggagaggactttacagaaaaggaattctcggtcgagctctgcctggagatgactggcttacacttactaaacccagcgggtca

SEQ ID NO: 944 - DNA, 238 bp, Homo sapiens
ccattttgttggttagcaggagttcagacgcaagacaatgtcatagtggtagaatacagtatcaacttcaacagcaagcccatctctggaagctcccagaccattgtgccaatcaagtggaggaggcactttcatttagagaggcttatgtgaaccttatatgagaaacttgccaacctgcctctttgattttttagccttactatttctaatacttaggtgctatcttttagagacc

SEQ ID NO: 945 - DNA, 96 bp, Homo sapiens
tgcgcttgctcccatccatgtgctgtgaggaggcctgcagccccaacccggcgactcttggttgtggggtgcattctgcagccagtcttcaggcaa

SEQ ID NO: 946 - DNA, 43 bp, Homo sapiens
gcaattttccaaggttcatgtcagccacaaggatcaaaggagg

SEQ ID NO: 947 - DNA, 79 bp, Homo sapiens
ttgtctggctggaggtcttcgtccatgttggctggcgggtgaggtggtctccagaccagtgtaactctttaagaacagc

SEQ ID NO: 948 - DNA, 37 bp, Homo sapiens
gctccttgcagcaatatagcaacttagaaatggcggg

SEQ ID NO: 949 - DNA, 155 bp, Homo sapiens
ggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatag

SEQ ID NO: 950 - DNA, 99 bp, Homo sapiens
gggccactgccgtgttgaagaatcaccaccagtttgaggatccagcagaaatttctgtttgttcacaggacggtgccaggcaggttctcatggactcac

SEQ ID NO: 951 - DNA, 279 bp, Homo sapiens
cctatcacctcgagaagtaattatcagttggtttggatttttggaccaccgttcagtcattttgggttgccgtgctcccaaaacattttaaatgaaagtattggcattcaaaaagacagcagacaaaatgaaagaaaatgagagcagaaagtaagcatttccagcctatctaatttctttagttttctatttgcctccagtgcagtccatttcctaatgtataccagcctactgtactatttaaaatgctcaatttcagcaccgatggccatgtaaata

SEQ ID NO: 952 - DNA, 130 bp, Homo sapiens
tgctgctcttctgcgagttcatccgccatgatgtcttctcccatgacgcatacatgtgtaccctcatatctcgaggagatttgtcagtcactgcctcaactcggccgcggtcaccagtaggggaaaatgc

SEQ ID NO: 953 - DNA, 1545 bp, Homo sapiens
aacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatttcaagggaccacagcacacccttgaaaattaccatttatttaatgccagttgaaccaatgggtagcaaaagaggagggagggaacatggtcatagagacaaaatctaactactataccaggtcttcctttgtaagaaatattagccctgccaatataaaacgcagatggacatagacagaataagcatcgaggactttttcttatttacttgaaatctagaagctcagtcatctctgctcatccctggacccactggagagttttactcactaacaggtcctttcctggaagaaataacctcatctcctgccatattagtttacaataaaaatcattccaaagtgagccatttcacattgcatttttgccacatgcacatttgctattgaaaccacagattctcagcataagtaagacataggtgtttcagaaacttcataaatacacgatctttcaggtgctcctcaatttcttaatcaaggtatattgaactccagtgattaggatagaacctgaaaacatcctttgttctattggatagtacaacacagcaagagcacacagttatttgtataataaaacaacttaattaatgaggaagatgggatgtttgattcctgctaccaccagttcacttcacaaaggccttcttctggtattaccaggaaaactttcctgcattttctagggaaaaagaaaagtcgtttattaggagcacaatgcagatatgtatctgtgttttcatagcttcagcaaacttcttagtaaaattcccatttcaacaaaaaccaaaatactgattgtttgaatgtagaaaggtatagaataaagactacaaaggggaattttaccagggctccttagaccagcttccccagcataatttttatataactcaagtaagcctctgcttcccctctcctttccagtataatataagaaggtcggaactgtcgcacaaaagaacttgatttcaatatgaaaatataatatgtaattttggggactgcagactttctgcatcaaagatctggacagccttaacttttataaaaataatttttcaatgttctcttttactaaccaggaaaacaagatgttttctgaaattaatgactttttctattttgggtctgttttctaagtttttacaggttgaggtataaagggtcgtcttctcctcatattgcctcttcataatcacctgggg

SEQ ID NO: 954 - DNA, 203 bp, Homo sapiens
cgaggtaagcgtctttcccaaggagcctgtggatctgggccagcccaacaccctcgtctgccatgttgacaagttcttcccaccagtgctgaacatcacgtggctgcgcaatggggagccagtcattgagggtattgcagagaccatcttcctgcccagcaagaaactcagattacacaggttccactatctgaccctcgttc

SEQ ID NO: 955 - DNA, 29 bp, Homo sapiens
acaccagtgacagtggccgttccacccag

SEQ ID NO: 956 - DNA, 266 bp, Homo sapiens
cccggtatcagagctaaggtagaagacgccactggagggtttcactcctacttccccaatcttgcctgagtccagatattgtccctgccatttcttagctgtgtgacctggggcaagtcgctttccctctctgtgcttcagttccctcatctgtagagtgggaatgataacaggatctaactcatgagattgctgagggaattaaatggcttaatcctcccgagtatgcagcacagcgcctgtgcagcagcagtctctaaccatta

SEQ ID NO: 957 - DNA, 109 bp, Homo sapiens
ctgcagcccgcagtgaacacatgtgccccgacccagcgcagtcggctctgccctgcgcttgcccgtgtgaagggccagggtccttggctctcagaagagggatattctt

SEQ ID NO: 958 - DNA, 38 bp, Homo sapiens
tttaagaagctgctccgtgtttggccaaattggagaga

SEQ ID NO: 959 - DNA, 86 bp, Homo sapiens
gctgactcatgtacctcaccatgcagatgagggtgtgttataacccacagtgtgtctgtgtccctggatgaactgagcactttata

SEQ ID NO: 960 - DNA, 28 bp, Homo sapiens
agcttaaaggactgagagtagcaagcat

SEQ ID NO: 961 - DNA, 318 bp, Homo sapiens
cggttttcctgccacatgatgctgacggacctcagcctctcccggccttggtgcacatacaacagcctgtaaaagctccactttctattccagattgctgttatgcgtctgcttctcattcaaaggaaataagaggagatgtaaatcgtcgctgtgcagttacgtgtttaatgaaaatgatcttgcatgctagattcacgtccaggagcgagtcgcccttactgctggtattgaactcactctccttggagcgccccaaggctgtgggctgtgggggggcattagtgtgtgtgggcgcagctattatttgtaccagga

SEQ ID NO: 962 - DNA, 102 bp, Homo sapiens
aaggcggctcaggacatcaaagatgaggagcctggagacttgggccgaccgaagcctgaatgtgagggttacgaccccaacgccctgtattgcatttgccgc

SEQ ID NO: 963 - DNA, 241 bp, Homo sapiens
actaagtaagacctctcaggatctcaaagccaagtgttttacagagaagagaagatagaaaaggcatattatctaggagtggaaaagaattttatgctgaaaatgttgaagagagaattcaaaatcaaattcaacattccacctaggaggcttccatctctgcttaggagctgagtaatggaggtgattggtgtaagtgttcagtacctatgaagacctaactcttgagggagagactcca

SEQ ID NO: 964 - DNA, 466 bp, Homo sapiens
cccggctgctcttttttatagacgaagaaattgaggtacagaaaatccagtaacgttttaaaagtcacgtcatgaatgaaccaagatttcaacccagaaattgaggcttcactacaagtgaagactggggttttcttgttttcaattattgggagttttggatttccaggaatgtgcaattgtaaaaacccagcttcaggaggtgatgaaataggtgcagtggctctggcgtaagctctgaagccccaggctcaggctctattgaaaaattacttttgctgaaatattcctgtttttaggaacttccatggaacttgagccttcacgcagcatattttggcatctgattcaaagctaatagaggtccggaggattcccaggattaaagtctttaaacagaaactgtgaatcttgcctaagcaaaaggtgccatccctggatgggcttgcaccaccaacctttcagt

SEQ ID NO: 965 - DNA, 98 bp, Homo sapiens
cccatgtgctatgatgctggctctggtgtacattgaacggctccggcaccgaaacccagactacttgcagcatgtgtcatcctctgacttgttcctga

SEQ ID NO: 966 - DNA, 183 bp, Homo sapiens
gtgcatcgggcaccgggatgcaccccgagcctcctccccaccccgccacccacccagtgacctagcgttcctggcaccctcaccttcaccgggcagctctgggggctcccggggctcagcgcctcccggggagaccaggcacaacttggagcgggaggagtacactgtgctggccgacctgcc

SEQ ID NO: 967 - DNA, 51 bp, Homo sapiens
agctccagcaggactaccaagggctgccactggctgtctgacagtgcctgg

SEQ ID NO: 968 - DNA, 130 bp, Homo sapiens
ccgctcagaccagcttggtgatttggaggtgaaaatggaacccgcgacacccggctcttcgctcaaacatgggtggggcggcccatgcaagtggaaagtcggagaacttttctcagaccgaggctgcctg

SEQ ID NO: 969 - DNA, 115 bp, Homo sapiens
tgccaaatctcaggagcaagtttttggtttagataaagaactgaagaaactaaagaaagccgtggccacctctgataagctagccacagctgagctcaccattgccaaagaccag

SEQ ID NO: 970 - DNA, 76 bp, Homo sapiens
cttcttacaattaggaccgagtgccgatcctgcgctctcaaccttggagtcaagtgcccggatggttacaccatga

SEQ ID NO: 971 - DNA, 226 bp, Homo sapiens
catgaaacttatatgtagacgttcctaattagtggcgtgtctgataccaaactaggtatcttttaaatttttattattctactatcagttatattcatttttcccctcataaaatattccttaaagtaaagaataaaatttcacaattcatttcagactcttcttatcctcctcccctccaaaatttctacataactgcatggggtcagttacagatacatccaga

SEQ ID NO: 972 - DNA, 82 bp, Homo sapiens
tgactgcacggctcagaaaagaattgcagctcccttggcggatcccccagaaccccctgtgatgagctttgggaacattttc

SEQ ID NO: 973 - DNA, 188 bp, Homo sapiens
aagtgtgtctgaatgacttcgcatgtttagtgaagctcattgccagaactgcgacttcccctgttgccttgaatctgctgatcagccctggcagcacacgttttttaaattatttaaaaagggacaagggttataaagatgaaaaccacatttttaccagcctctgcaaactcctaatttggtgggtg

SEQ ID NO: 974 - DNA, 116 bp, Homo sapiens
atgtgcacgtgagaaatgttccctgggtcctaagtgcctttagagctgggtcaggggactggagacccgctgaggaaagtgaagtcagaaccccataggcggacggtcatcagaga

SEQ ID NO: 975 - DNA, 277 bp, Homo sapiens
gctgcagttggtctgtcaaacagtccctgccttctgctggaagcccccagccccaacccctgccagctctccccaacttgggaagctcagtggcctcggtgcaaggctggcacatgcagagaaaacaaacacatggagccttgccagctggatcaggcaccactgtttacagcaggagcaaagtgtggggaattggagaggcatgaagaagggaaggagcagagggggtggggataattctagcctcctgctcttaggctccaccagttgcaaagag

SEQ ID NO: 976 - DNA, 70 bp, Homo sapiens
cccagtgctctactgggggatgagagaaaggcattttatagcctgggcataagtgaaatcagcagagcct

SEQ ID NO: 977 - DNA, 33 bp, Homo sapiens
agctcccctccacaataaacgctgtttctcctt

SEQ ID NO: 978 - DNA, 132 bp, Homo sapiens
cactccctaccctgatgttgacaagtgcagcttgttttaaaactgggcgctgcattttacatggaaaagattttattttgaaatctagggtggagtaaaactccagccagtgaagacttgccatgtgctgtg

SEQ ID NO: 979 - DNA, 89 bp, Homo sapiens
aagtccttcgggaatgcggttgcaagggcatccggacctgtctgatctgcgagcggcagcgcggcagtgacccgccctgggagctgccc

SEQ ID NO: 980 - DNA, 479 bp, Homo sapiens
caggggacatccacaagtacacatctgtggtcactaaggtgaccagctcatcccagttggcctggaactttcccagtttaagcactgaaaactccttgtcccagccctgccggtttcccaacaaactgagatggttggccgctcaagtggctaccctgaccatcaccccaggctctactttagcgactgctcacacctccctgcttcccagacagaagtcaaaacagcaaaagaaacccagtccccagggtcatgctagggctaccaaaactgggatgaactagcacctgtgaactagaacagcagggagtatgcttagagtgcctggtcctgggtgtggggaagaaaggccatcaaggtagatgcgggtggggaacagcttgagagaggaggcaaggacaacccagtttctgtctgaaggggcctctggttgaccctggagtttctgtccccaaacacaggcctcacgggattctttc

SEQ ID NO: 981 - DNA, 40 bp, Homo sapiens
cccacttctgtatacataaacggccaaggtgtgtgcccgg

SEQ ID NO: 982 - DNA, 32 bp, Homo sapiens
atctgtgtgaccctgttcagacatgcatgcct

SEQ ID NO: 983 - DNA, 33 bp, Homo sapiens
atgaagcaaggaaacggctggtactctgggaag

SEQ ID NO: 984 - DNA, 137 bp, Homo sapiens
atgttcagattatgggtagattccagttgttaaagaggttgtgtgtgttctagttagtaaaggagagagaaaagatcagtaaactttgttcagtgatggcctttgattttcctacctcatcccaggatatgtatggg

SEQ ID NO: 985 - DNA, 30 bp, Homo sapiens
attgtaaaaagccatctgggctaacatttc

SEQ ID NO: 986 - DNA, 62 bp, Homo sapiens
ataatcatattatctaaggcagaagtggtggttacttggcaagaatacgatttcttttaatg

SEQ ID NO: 987 - DNA, 168 bp, Homo sapiens
accttcattccagaggcatcctgccctgtatccgggaagaaggaatgctgcacacagatgccaagaagaatcggaacagacaggcattgctggatcccccctcggtctattaccacgagatcaaactcttttgtccaatcacatgtctacagtgctgtccattcttca

SEQ ID NO: 988 - DNA, 272 bp, Homo sapiens
caaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccatt

SEQ ID NO: 989 - DNA, 50 bp, Homo sapiens
ccaggtggcagctgtctaactggagcaggaactcggagacggatggggac

SEQ ID NO: 990 - DNA, 40 bp, Homo sapiens
atgggtttgctttgatcggaccaaccggattcctgagtgt

SEQ ID NO: 991 - DNA, 354 bp, Homo sapiens
ccaggtttatttctagaggcccatgggtatttacacttttccttgtgtgttgttgagtataccaaaacagaactgccagccattagcccatggcttttctgcctacgtgaaaacagcaggattatagtacaaagggcagagacctaagccaagattatgtgctaagaagaacggtaagagcataagcccgctgaattactggcaccttatgatcctggaactgagagccctgacagggtttgatccactattttggttctttctgctctacctctgcccatccctcctaatgcagataaaattcattcattctttcactttcaagtatttgcagtcacgcatcccttaacaatg

SEQ ID NO: 992 - DNA, 49 bp, Homo sapiens
gcctcgggctgcagactctgctggtggattcagcgatgaggccctcaga

SEQ ID NO: 993 - DNA, 296 bp, Homo sapiens
caatttacggcaatagacatttacagaacaaaaataagacagttccaagacaaaggagtgtaaaagtacagcacacaggttaatactcttcaccctcatcctctccgtcagcactatctgctccaacctcctcataatccttctcaagggcagccatgtcctcacgggcctctgaaaactcgccttcctccatcccctcacccacgtaccagtgaacaaaggcacgcttggcatacatcaggtcaaacttgtggtccaggcgagcccaggcctcggcaacagctgtggtattgctc

SEQ ID NO: 994 - DNA, 79 bp, Homo sapiens
aaattctggggctacatttccatcctgtatgaaactattgaacatccttggtcaacactctctgtagagatttgtttta

SEQ ID NO: 995 - DNA, 232 bp, Homo sapiens
ggcataattcgcacctggcacaacatcctagaattcacattggagagaaagcttacaagtataatgaatgtgacaggtctttagtgggcagtcaacacttgtttaccatcaggcaatccatggtgtagggaaactttacttatgtaatgattgtcacaaagtcttcagttacactacaaccattgcgaatcattggagaatccataatgaagagagatcatactagtttaat

SEQ ID NO: 996 - DNA, 103 bp, Homo sapiens
attctatcttccacccggtctgtggagacaatggaatcgagtacctctccccttgccatgccggctgcagcaacatcaacatgagctctgcaacctccaagca

SEQ ID NO: 997 - DNA, 73 bp, Homo sapiens
cgctgggatccgcagaggagcccacttgagagcgcctcctgtcgtctgtaaggttgccttgccatccctcggc

SEQ ID NO: 998 - DNA, 257 bp, Homo sapiens
gcggaggtgaatggcttcctgttctcacctccgggtccaggcactgggggtgaggaagtggctgggaggccaggaggctggaggaggggaggtgctggggcccagggctgtgcgggaggggatgggatcctgtgggtaccttggcccgtgtgccagggtcgggggaacgtgacactaggtgagaattgggtagaaagtgtgtgtgaaagggcatgcgtgcatgtgatgttggtgccatatctataggtgtcgttgtc

SEQ ID NO: 999 - DNA, 54 bp, Homo sapiens
atggtggctactgcaaggggttttttgtttagggagaacgcactgtggaactca

SEQ ID NO: 1000 - DNA, 183 bp, Homo sapiens
agtaaatgaccatcgtgcgcccatgggaagagtgctgcatccacggaggacatgggccaacagtgctctcaaatgggtttcatgaaagcatctgtgactcatccctgttcaagaatgttttcattacgattcagcagaagcgatgtgccaggtcagcaaatacaactgcaaaaccggggcctg

SEQ ID NO: 1001 - DNA, 379 bp, Homo sapiens
catttcgggatgtttggagtcaatcagataaagcacattatgacagaaaccataagaggggagctgggacctgggactgtgcagaatgaaaagccacggctacgggaagcataagcttgtgctgcaacggcatgtgcacatgacctgctgctcctggccctctacgaagcatgcccagcaagggaacctcctccgtccctcctccacgtgcttccttcctaaggctgagagctcaactgaagaccttccccaataaatgacagatggctcttcagtcaggaatgcagttagtggtttcatgacagacacactggtcccacccggcttccctgctgaaccacccagtactgaataacacctgtaccaatgtgggatgaca

SEQ ID NO: 1002 - DNA, 119 bp, Homo sapiens
agccacttcaatgcagctctggggatccaccagtaatgacggggcattccccatcaccaatatatctggtactagcatggggcgttacagctgctgctaccaccctgactggaccagtt

SEQ ID NO: 1003 - DNA, 400 bp, Homo sapiens
ttattctggcacacaacctggtttacattttttgaattattatttctaaactatacattggtgaaaggagatggaaacattatacaacacacaacacaaaattatgctctattccagctctgttgtcccctgtcctctgtaagaacgcaaggcctgcagatgttccccaaatggaggtccctaggacagcaaaggtgcccctcaccaccttctgtcaccttcaccccacccttttcctccctccttcagccccttgatgtttctaattccgtcctgtctcccattcaaagtttctatcttgcccttttccccaagttgctatcttctgccttagaagcaagtcccaaatttcctttcatgttttacgtattttcaccaattctggtgtccgttgtaaatc

SEQ ID NO: 1004 - DNA, 97 bp, Homo sapiens
gagtaaggttggagcgttctccctacccccctcctgtgcggctaagagggtgctgaccgtctcccctgggcctggtgaccaagccagccttgtccac

SEQ ID NO: 1005 - DNA, 210 bp, Homo sapiens
atgacgagacccttgtttgcacagcattaataagaaccttgataagaaccatattctgttgacagccagctcacagtttcttgcctgaagcttggtgcaccctccagtgagacacaagatctctcttttaccaaagttgagaacagagctggtggattaattaatagtcttcgatatctggccatgggtaacctcattgtaactatcatc

SEQ ID NO: 1006 - DNA, 162 bp, Homo sapiens
aaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaaga

SEQ ID NO: 1007 - DNA, 87 bp, Homo sapiens
agggcttaggggacatctactgagtgacaaaggcaatggggagatgacagtggtgggagcagctgaagtgacgcagtctattcgtcc

SEQ ID NO: 1008 - DNA, 463 bp, Homo sapiens
tgagcaaaaccacaggcagcaatcctcaagcccatttctattcttctggataaaaaagacattttttttttttttcaaaatataggggatgtcatctttttcccagccatcttgtgagggaagaagatagcaagacagaaataactccttataatcttttcaaataccaaagcattccacttcccatgcaatcattttgaacctctaacacgagcaaaaactatagctgttatggagaaaagaactcttagtttgaaaagatcgagtactagcatatagaatcccccaaaccactttaaattaatgagtcatacaatatatctgacatgttaccaaatcctccccagacccaaggctcaacagtttttgaaatctcaacacacattttctgaggaattgcagtttggaatgaaactagggcttctggtggagtgatctgtacagtagtcacaggatggtcctt

SEQ ID NO: 1009 - DNA, 316 bp, Homo sapiens
tgctcgatggagtcttcaacgtggagctcaagctgaccggggctgggcctcggcttatcgagatcaacccccgcatgggtggcttctacctgcgtgattggatcctggagctctatggtgttgacctgctgctggctgctgttatggtggcctgtggcttgcgtcctgccctgcccacccgcccacgtgctcgtggccatctggtgggcgtcatgtgccttgtgtcccagcacctgcaggccctgagttccaccgccagccgtgagaccctgcaggccctgcacgaccgtggactgctacgcctcaatctgctgga

SEQ ID NO: 1010 - DNA, 83 bp, Homo sapiens
agctaatctagcctgggctcggttgtaccagactcaactccagacttcttgtcagattcacatttgcccgcggtcttcattca

SEQ ID NO: 1011 - DNA, 669 bp, Homo sapiens
aggctaggtcaggttcttgaacatccttgtgaaattattcttcccttaagtctgggttaaattataaattatgatctgcatttaaattcccaaatttaaaacaaaccaaacaaaacaacgcacttcagactcttttggaaacctttgaaaggaacttgatttctgtgtgatttgaaagtatatattgcaatcaaggtattggtggtaagtgtgtttttgaggtttgtcacaaattaacaaaattatatgcctaaagagttttgcagagaaatgcaaatcattataagcgccttgtcataataagtagtgtgctttggttcctgtttatgtatccctaaaacacataatacactattacattgacacgaaggaaaccattctcattgatggtttctttatatctggcccccaaattagtttgtggtatcaatcagtataatttctagagagcctattaagcctatgtttgtacctgtctttcaggtataagccttgtcttctgcagatgattcttgagcacctactatatgccaggccccagggtttccatggccttaaggaattcccaggctggtgaaagtggaacaggcttttgcctaatgacaaacactatataagtgatgactttggagccttaagggagggcctactctagcagcacagtgaaga

SEQ ID NO: 1012 - DNA, 31 bp, Homo sapiens
gtcagaagaggaatattgcccggtttgccag

SEQ ID NO: 1013 - DNA, 80 bp, Homo sapiens
tgtctgtcccggaaatcagctcctcccagcatcctgtcaaaaccggcctatcggatgccttcatgattctcaatccatcc

SEQ ID NO: 1014 - DNA, 126 bp, Homo sapiens
ggtataccagcgaccgctgtgcctttagccagctggcagccttaaggggagatgaggtcccccaaacgaattcagttaatgccatcatgggcaccactcccacagcagttacgaccaggggaggcc

SEQ ID NO: 1015 - DNA, 28 bp, Homo sapiens
gccatccacatggccaattcaacctgct

SEQ ID NO: 1016 - DNA, 261 bp, Homo sapiens
acatcttccttggtgacagccagtcaagtaaattttacaaaatttctccacatgcctggaaattcctgtgaagaagactgatgaaagaaaagtagcctcagctccaccaacatatttatgacttttcattggtttaagtttctttccttgcaagattaaaagtaaccagtggtctgaaacgggacggtggagaaatgacagcagatgatgatcgctgttatttcctgaaagggagtgtgggaactacaaggctcagctcta

SEQ ID NO: 1017 - DNA, 156 bp, Homo sapiens
tggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttg

SEQ ID NO: 1018 - DNA, 164 bp, Homo sapiens
acaggccacgttaggaatgcatattttataacttgaataatgtgttagcctcttacctcttcactatattggttacctttcaaacatacaagggctgagttctttctccctttagatcttagcgtaaatgtcactgctttggggaagcttttccagcccatgcc

SEQ ID NO: 1019 - DNA, 127 bp, Homo sapiens
ccactattatagcactgtttacatgtgtccaaagaaccaccaaaaaaccaccacaatgatacaggtatctactgcaaattttctgcttcttgtctgctaccttgtaaaaggtacagcctcccaatta

SEQ ID NO: 1020 - DNA, 64 bp, Homo sapiens
tccatggtcccgtgcctgacttcatggatggttcaatgctgcagttcgtccagttcatggacac

SEQ ID NO: 1021 - DNA, 97 bp, Homo sapiens
aaatctgggagtgttctttgtgagggtggaacagactccctgtgacagggaactagatgaaggagtcttgagaagctgatgatcaggagtggtcaca

SEQ ID NO: 1022 - DNA, 307 bp, Homo sapiens
tgccttcacatctgatatgtgtttgtctttttctccgaatttttttcctgattttagccagtcattcacatctgcattttgtttgtccagttctgagtttttaagttgctatttcagattttttaaatatctaataatttaattcatattagcatattgtgttaaagtttactctcctttttctcattttcaatttctctttagagtgactttattttttttccctagggatgtaattttatgttgagttaccagcaatactaggtcatcaaatgggaagaaagggtctgggttagttcaagaatat

SEQ ID NO: 1023 - DNA, 303 bp, Homo sapiens
ggctggacactggactaagacactgaattctgtaagccccagtttctctctatgaaactcatcccctgcttcacaagctgttgggctgattgactgagataaggtcggttaaagcttatagcacagggaaagggcttagttaatccaagttctctactttattcagaaaccacagaaacagttcacaagagtcttccttttcagccttctggtgaacaaaacagaactatttttttgcaataaagtagatggtagatgagaaagtagaaataagggaacatttatacattaacctggggtcta

SEQ ID NO: 1024 - DNA, 182 bp, Homo sapiens
cacgagagtcagctgttggagaattttgaaatcattgacaagcttgtgtgttcattaagattcttctctttttagggtttctccccttctcttctttcttttccttccttgtcccctttccccagaaaacattttttaaaaaccagcagttagtgcaactaatgttcagtcagcacacagtg

SEQ ID NO: 1025 - DNA, 28 bp, Homo sapiens
agcttaagtggacaggttctgcccctgc

SEQ ID NO: 1026 - DNA, 155 bp, Homo sapiens
caggcccaagttcgcccagaggtgacacacttgggaatttgtggtgccatcgtgccaggtccctcctcgtaaaagtgcctacccagcgcctgcaaccagagccaaagcctggacatgatagggaaactcttgttaaaacgcgacacgtggtcctg

SEQ ID NO: 1027 - DNA, 284 bp, Homo sapiens
tgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcc

SEQ ID NO: 1028 - DNA, 28 bp, Homo sapiens
gagtcagctggacgtggtagatcatgcc

SEQ ID NO: 1029 - DNA, 311 bp, Homo sapiens
tggggctaattatagcaccatcctcctaggattattacaggaattaaattatttaacagatgagaccaaattcgcactgcccagaagttaataagcactagataaatgtcagctatgattattagttactaatctaattattatcattaggaagtcatttaatttaactgatttgactggtaggttcttcatgagttatcaatcacacagagatttaccaaggaaaggccataaagaaaagaaggaagaaaattagcattctttgtcagcttcctacacatgtgatcatttcaggtcaggatttcacattc

SEQ ID NO: 1030 - DNA, 573 bp, Homo sapiens
tccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctata

SEQ ID NO: 1031 - DNA, 159 bp, Homo sapiens
gcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctg

SEQ ID NO: 1032 - DNA, 92 bp, Homo sapiens
cctgagataagtgcccgtacctccatcattgacttcactgtcaccatgaaaggtctagaagatcagttactggggagggtcattctcacaga

SEQ ID NO: 1033 - DNA, 503 bp, Homo sapiens
ctgggcgttgcgttaagttgcttaactttcattctgtcttacgatagtcttcagaggtgggaacagatgaagaaaccatgccccagagaaggttaagtgacttcctctttatggagccagtgttccaacctaggtttgcctgataccagacctgtggccccacctcccatgcaggtctctgtggggtctttgggatggatctcctagggctgggctggaagcctcatgtactgttgtcttctaggtaaccaccctgaagagaaggggtggcatcaggaaccgcagggaaccaagcagcctttggtccagtgctgctccttggaacagttgagtgtggcctcaaaccattctcctgggtagctcagtcataaaacaccgaatgcctgcctcaaaatagcctctgagggaagggagctgttgacaagtgaagccctcaggttgtgtgggattccagcaggttattacagcttgtggggggagggagggtccattccaccagcttt

SEQ ID NO: 1034 - DNA, 216 bp, Homo sapiens
gtcaggggagggacttatatgatttggatctgtgtccccactcaaatctcacaccaaattataatccccaatgctggaggtggggcctggtgggaggtgattggatcatgggggcagtttcttatgctttaacaacatcccccttggtgttgtcacagtgacagtaagttatcacaagatctggttgtttaaaagtgtgtagcatgtccctctgtc

SEQ ID NO: 1035 - DNA, 190 bp, Homo sapiens
agcactgcgaatggggccaagaaattttggcctttctcgccggacctggctgcctccgcgggcctctccgcctaccgcgctcccgccgcggcccgactcccgcgggtctccgcgccgaacccacctggctcctatcgcacgggacattcccgacccacccacgccgcgtcactgagcctctgtaccgata

SEQ ID NO: 1036 - DNA, 219 bp, Homo sapiens
accaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgattttta

SEQ ID NO: 1037 - DNA, 70 bp, Homo sapiens
gagaattttgcccagcagtccctcgtggctccctccacaccactgacccttacgcatccaaggttggagc

SEQ ID NO: 1038 - DNA, 1669 bp, Homo sapiens
cctgcagctgcataagtagtgtttcattgcaccccagcaggagctggtaccggttcttcccttgcctcatgctggggtagattttatttaggattgggagcagggaaaggagctagagaaaggaagggttccaggaagctgggaagggagatgtcaggtggggtgatgggaaaggaggccaaggaccacctttgcctgtatggtgggctgaactgtgtccccacaaaagatagggcgtcctaaccccagatacctgtgaatgtgaccttatttgggaatagagtttttgcaaatggaatcaagtcatgatgacgtcattagcatgagccttaatttaataggattgatgtccttctaagaagagaagacagggacacacaggagaaagccatgtgatgaagcaggcaggagctggagcgacactaccacaggccaaggaacattgggaccagaagaggcgaggaggggccgttccctagaggctttggagagagcatggctcatcaacaccttgacttcagactggtagcccccaaacggtgacagaataattgtctattgttttaagccccctggcttatagtacgttgtaaaggcagccctaggaagccctaagccagtttcactcattatgataaatatcatagatgatgactgtcatatattggatgtgctggagatcttcacagccacagaataaactgcaggccaaaaaaagaacattcatatgaggtccccagcaggggctggctgtgcaagtcagagactgcagaaccaggtaggcagacaaagcgaaattgcctggagctggacacatatgtgcaccactgggaaataaatagacttgcggtggaaatgaccaacgtggatggccagggaaatgccagcagcaataaaagaaaagagtgcacaaggcctgtaaatcagcagatgcgagagctcccgaaaagtagcgaagtctgaaataaaaggcaggctcaggctggtggtccaagaagttaaagcaggaaatgagagcgtgggcactgtgtgtgctgggctcccaaagactgcagggagtggccagatgtctccagaggcagcgtcatgtggagcaaaggggacctgaggagtgtcagcatcctcagtcacctcctcctttgaaccagctgttcggaatctggtctcttacttaggataattgtaggaactgactttttttttttttcttttctcacctattggctgactgaaagaaccgacttttaaatgagcacctccctcattagaattgctcaaatgacaacagctgcagcggtgggagcagcagcaagtttgaaaatccaacagtctgcattccacagtgacagtattcttggtcacctcggagacatggcagccgggagccacggctctcattgctcggggttggttgggttaccagccctagggctacagaatgtatctaaaagagaggcttggctggcagtttaagaggggtgcaggacagcaggatggggttcatgaggcaagagtggatggagcctgtggcccagttgggatgagatgggacagttccaatgggcaggacaaaccccagccaccgtctcagggtatttgacaggaggtaaacagcagacaaaatcctggagcacaggggggcagggctgtctcgttcccatgaatggca

SEQ ID NO: 1039 - DNA, 100 bp, Homo sapiens
ttcccttgccattctaagtttctcacagtattagtgagattttagcaaatggtgccctgcctcctttttccccttcccacacttctttctgtgttgacag

SEQ ID NO: 1040 - DNA, 357 bp, Homo sapiens
tactcatgggaaattgggtactgcagagcagaggagtggaatgtagtataaaatattagtaaagagcaagcactttgaattcaaataggtctgatttggttactgatgttgccacttcttacctgtgtgaccttgagcaacttaacttacctcttgtgttagttatctattgtcacataacaaattaacgaatttagtggcttaaaaaaacatacatttattatctcacagtttctgtgggtcaaagagttggggcatttttactggtcttccgcctagtgcctcagaaagctgcaactcacgtttaaatcaagcctgggttctcatgagaggctcagctgggaaacactccatttc

SEQ ID NO: 1041 - DNA, 580 bp, Homo sapiens
taccagtgggtaatgtagggctcgcaaaggtatagtaaagctaggatttgcagtcactgtattgtcatgctaagaccctgttttggatgcttgtgttctctactgtagatgttttaaggatcacgaccactgctgtgtattaaaatcatgcagagtaagggtgctgccctgtgtcttctgttctcacagagatctgctccacaaagagagggacttacatctaggtttgatcagggattgccgtaatttttctgtaaaggaccagatagtaaatatttacagctttatgggcctcatttgatctgcttctgtagtgaaaaagcagccacggacaatattcatagcaatagggagtaggctggatttggcccctgagccaaactacaggggtagtttgttgacccctggtctatatgcagagtgagggagagagatggatttaaacccatcttccttaggccacttcatgtgccctttcatacacattagctcttggattagcagtacctgagataagggtggtatggaaaatagagtctaaaccagagagctgagggcaaacttggcattccttccctta

SEQ ID NO: 1042 - DNA, 161 bp, Homo sapiens
actggtggaatggtgatgtctctgacagaaaccaacctagatctgtgattacaatatatttgggagttatgacaatcttatcacgagtttcatctcctccatctctgttttccctgccccaactcataaacttccttgtattaatacaaagatgtcttgga

SEQ ID NO: 1043 - DNA, 390 bp, Homo sapiens
gggagtccgtatcatgtcacagagaagcgtacaagcttaggaatcttgttttctgaattcgaatcgcaggttgccagttacacctgtatgcgactcaacaagtactttaacctgtctcttagctgttatactacaaacctcaggcttgttaagagaaaatgctccgcaaggaactaaacacagaaggttctaacgctgagccaagactgggaaacgaactctgggaactcaccccaggctccccaagaacatcgcccctctggctggagcgcaattggtgattggctacttaacccgtccgtcctttcccgcccaggggtccaatccaatccagcccggctccgctcggagacagttcgccgagtgggcggtgtctatgacgttttctga

SEQ ID NO: 1044 - DNA, 63 bp, Homo sapiens
gaagctcggtccacctctgaagctggagctgctgtcagtcaatgctcagaacctcttggcaaa

SEQ ID NO: 1045 - DNA, 41 bp, Homo sapiens
ttcagtacaatatgatcctgagacaacagtcccactgcctt

SEQ ID NO: 1046 - DNA, 55 bp, Homo sapiens
ctctccagtctattgagcccctgcccccacaccctatcgggttcagagcagagct

SEQ ID NO: 1047 - DNA, 147 bp, Homo sapiens
ccaggactggtgataagtcaccacgcagaccacaccttaagtagcttctgccagtggcagtctggattgatggggaaagatgggactcgtcatgaccacgccatcttactgactggtctggatatatgttcctggaagaatgagccc

SEQ ID NO: 1048 - DNA, 378 bp, Homo sapiens
ttcagtatctttggccttacagaagtttttaatttttatgagatcgtattcgtcagtccttttctttatgcttttatgttccatgcctcacttaaaaaggccctctttcccccaaggtcataaatatattctatacccttttcaatatttttatggttttagtttttatgtttagcacctaactccatctggaatctatttttgggaatcgagtggtatgtagatagatttcatgtctgacaatatatatttttgagcactcaaatttttaaaaagtatgtatgactttggtaagcagaaagagccaagaggagtttgaagagacactcagaaagtggatgtccattctgggtgggcccaggagtttgcaattttagc

SEQ ID NO: 1049 - DNA, 2606 bp, Homo sapiens
gagattgccacgtgattgcccagtgtgattgaaagtttgaagtccgtatttctctgaaaactttggtgtatctagattctgtatgtctcttggacagatgaagagctgctgtacacagaagggagatttttttttttaattgaggaatctaactcaagaataaattcaaggccaggtgcagtggctcacgcctgtaatcccagcactttgggaggccggggtggaaggatcacctgaggtcagtagttcgagaccagcctgaccaacgtggtgaaaccctgtctctactaaaaatacaaaaatgagctgggggtggtggcgtgtgcctgtagttccagctactcaggagactgaggcacaggaatcacttgaacctgggaggtggagattgcagtgagttgagatcataccactgcactccagcctgggtaacagagcaagactccatctcaaaaaaaaaggaaaagaaatttggatcctttagaaatcttcagacacttggcataacatgaagttaaaacaacaccccacttagttccatgatatttctgatgaataagaaatatgacaccacagagtgaaaccaatatttttaaaaacctcctgaagagactttttttctttgttgattaccatccagagacaacatttgtttgaaactttgaacagaatcagtttgtagggatgaaaccctcattcttccccgcctgggcccagactttccatatcttgtactctgagaaccttaaagtcttgaaatgatttgcagtcccagcgaagaagctaaaatcaaaactgatttggggaaaaaccgtttactttctgacctctttgtactcttcagagaatttttgtatgcttgtttattttcttaatgtctcttggtaatgttttttcctgttttggtttcatatatgaaatgttccatctgtgtattcattttctggatttattccctagaattttaagtaagagtgtttctcaaactttttttttactccaacccacaataagaaatatattttgcatgttaacctaaatacacatatatttacatatatatctaaaacaagtttcatgaaataatactcttgcaatgaggtatgcactatggttttttaaaattctattccactttatatatacaaaagttgggacagaggttcaggagcagggaagggatgaataggcagaacacagggcacttttagggcagtgatagatgcatgacattatacatttatcaaaccccacagaactgtacaacaaaagagtgaatcctcatgtaaactgtggactttttattattattttttaagacagggtctcactctgtcacccaggctggagtatagtggcacaatcttggctcactgcaacctccacctcctggattcaagtgattcttgtgcctcagcctcctgagtagctgggattacaggtgcacgctaccatgccaggctaatttttatatttttagtagagacagggtttcaccatgttacccaggctgatctcaaactcttggcttcaactgatctgcctgcctcggcctcccaaagtgctgggattataggtgtgagccacccaccatgcacggccaaactatggactttggttaatgctagtgtatcaatattagttcattaattgtatcaaatatactttctgtgcaatttttgtgttaacctaaaattgttctagagcatattataaatatttgtaaaagtaaaacacgaagttggatttagcctactaaaattgactttactatccattaatgacttgctttccatggtttgaaaacttgtggccgtggcctggtggggagtaccctgggtttctcttaggttggtgcaaaagtaattgcggttttgccattaaatggcaattacttttgcaccaacctaataactacatcccagcctctgtcactctatagagcctgcccttcaacaagccacataataatgtctctcagctttctcatctgaaaaatagagtgtttgatcagatgaatgccaaggtcctttccagatccaaaatattatacctgtaagtataaattctcattttaaaatgtcttagagtaaaagaaaagtcatgaagcatgaattgtaaattatgtgcatgttatttaggcatgttttatgttttataggcatcaaatgggtacttttcatcttatttaaaataagtaaaatgaaaagtaattgttctccagcaaaatatataaattacatttctctctgagttcctgattcaagatctctgtagaagaagaataacaaagaacacctaggaatgatacaaatgatactttcaattttggcacttgtctgccctactgccatgtcctcatgagagtatccctgaactcagttctcgttggtcatttgacgtttgctgggagcgtactatgggcgaggtcttatgctgagggtgagcctagtggtgtctcacttcttgtagcttgggtcaggaaatggagatcagctactgtatcccagaaccttcttgccttcccagtcccaaggcaggtgctgtgggaagagtgtgtataaggtctgatggggacagacctggggtgaatctcagtggcactt

SEQ ID NO: 1050 - DNA, 138 bp, Homo sapiens
agtcaagccgcacacgtcttgctctcattatctgcaatgaagaatttgacagtattcctagaagaactggagctgaggttgacatcacaggcatgacaatgctgctacaaaatctggggtacagcgtagatgtgaaaa

SEQ ID NO: 1051 - DNA, 41 bp, Homo sapiens
atgcttgtcccagtcctgatcctaagcccctgcctcgttgg

SEQ ID NO: 1052 - DNA, 91 bp, Homo sapiens
gggcccaaccactctccacatggcagccaggaagaacatgggtgtttatcagactgtgtcacttacaatcaagtccagactccacaccaca

SEQ ID NO: 1053 - DNA, 76 bp, Homo sapiens
ttgttgatgaggaagttgatgtccaggatccccgccaaggttggacacccctggcctgccacggagcacaggagca

SEQ ID NO: 1054 - DNA, 54 bp, Homo sapiens
agaaactccaggtattcgaggccttgcaaagtgtgatgctcaccctcatctctg

SEQ ID NO: 1055 - DNA, 30 bp, Homo sapiens
tgcaatactttggtgacaacttggggcgaa

SEQ ID NO: 1056 - DNA, 133 bp, Homo sapiens
atttgcagcgggatcgttctgtgacgggcggtgggcagcccaggcagggctgccgtttcgtgtatcagcccagaggtctgagaagggtgtggctccttccctgggaaacaacatgggactagttccagagcca

SEQ ID NO: 1057 - DNA, 157 bp, Homo sapiens
tgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacg

SEQ ID NO: 1058 - DNA, 280 bp, Homo sapiens
gtgtcagaaaatgaatccctcctgccttattccattgtcatatccctttgggatactaaaatctcggggagggaaagcctatgtagttacaaatggaaacttctctttcttccattcattttggtgggtgggacaaaggaaaagaaggtgaatatatatgtgattgcgaagcaggaagtctgcatttgtgtgtgaactccccaagtgattcccacgtgcacctcactgtcctttccctaccctacctcatatacttaatatgtccttttagtctcccaag

SEQ ID NO: 1059 - DNA, 748 bp, Homo sapiens
tttccaccgttgctgtagggctgcaggatccactgagtgcacctgcctttgtgctggaagccagggctcctctctgaccctgagggtccctggctctggggagggagctcgcagggctcctctctgaccctgagggtccctggctctggggagggagctcgcagggctcctctctgacactgagggtccctggctctggggagggagcactgtgttttcagtgcccacatgttgccaaaccgcgctccagaaagctgcccagtttctgtccctgccgaacgcaggagaatgcagggaaggatgttgtactttttctccagagctgcttcccttgaggggggcccctgcctacaggtcagaaggaagctgaggttccaagtcaccccccaggcgggcctggcctgtgtaacacgcaggcgtgcaaggcagaggagatactgatgcccagggcacagtgccgtgccctggaagaccactccgtgcctcggactctgcagcagcttctgatgccgcggaggtggctgttctgttgcagacgggaaactgaggcttagcggcttgccccaggccaccgagcagctggttggcagagcaggcacacgccaggagagctgcctccctgagcctcatttccccctgtgctgagggctgggcatgctgttgtatggccagcccacagcaggcaggaagtgttggcctcaatgcgtttccacagtggcctgcccaggtagggttaagagcacagctc

SEQ ID NO: 1060 - DNA, 77 bp, Homo sapiens
tggtctgatactaaatccacctccacaagtgaggatacgtaagaacacattagggttctttattgctgaaactccaa

SEQ ID NO: 1061 - DNA, 307 bp, Homo sapiens
gggcagtagggtcttgtgattccaagtcatgttctatgggccccaccatccaggaatgcaagcagatgagggcaggcagcagccaactggctgcttcgggctcatagcccagaacccaacaggaagtgttgagtggtggcctgccctaggaccgactccatgggtgtgtaacgagtgtagttgcacagggccccatatgcagaagggggctctgcacttggaatttaatgctatgtggctatagtcctgaaattcttaattttatttttgaagttgtgtcttttaagcaaaggccaacgggacagtg

SEQ ID NO: 1062 - DNA, 380 bp, Homo sapiens
gcccaattctgcactgaaggacaaggactgctgcaaaagaaatgagtgagaccctcaaaataaatgaaaggcacacagctcagccactaaggagatggacaagccatgtcaacctctgatctgctactttttgcatctataaaatggtaacactgctacttatacctcaggatgttgtgaggattaaaaattgagtaagctaagtgcctggtgcagtcctggcacagtcactaagcatttactatctttatgcagtttctttttgtaatgctaactgccctccaaattcctccaaagtaaacacatggattagtaaatgagaaagaaacaatgcttaaaacaactatgggtaacatacctgtttcaagtcgcgtagaata

SEQ ID NO: 1063 - DNA, 189 bp, Homo sapiens
gaagacaggttcctcacagcaaagcctgtggtgaaggtctcagaggcctctcaggggaagtctcaaggtctccagtaaggggaacgaggtctggagggaggaggttgtggatcctcaggcagggttgttgagggaggggggtctccaggtccccagaagcagggacctcaggcaggagtaccaggggag

SEQ ID NO: 1064 - DNA, 467 bp, Homo sapiens
ttgtctgtgcaccactgcggaactgtgagctcccagagtgcacagatatgtgccagacaccaagatcagaatgggtgcttcgcagtgctcaatacattatttattgaatgacttaatgtagaatgactagttacacagttcaggtgctaggaggcagtataaaagtcagagagcaaatgctttaagaaactgtagtatacaccaggaaatgcaattctttagttagataccttctcctttcagtaaaattatgttcagtgctgtaaataggcaactttcagtgatttgtttttcaaacaagtggctttttatcttttcctcttgacagtgagtgtctctccatgtgtgaagtattttctcctctcatatctgtgaagtcctgcttgtaagtgtttcggttatgcaacatttcatggggaatttgagcactggaattcttggtcgctagttaggtgggtcttaccgca

SEQ ID NO: 1065 - DNA, 48 bp, Homo sapiens
ctatggcaggtataccaggcccagagcaatgagcgagagaggtggtca

SEQ ID NO: 1066 - DNA, 183 bp, Homo sapiens
gctgaggtttagctgtcagttctttttgccctttgggaattcggcatggtttcattttactgcactagccaagagactttacttttaagaagtattaaaattctaaaattctattaatctctcattaatagtatttaatataaagattcttaaaattactgacgttatgaattggtttgatgc

SEQ ID NO: 1067 - DNA, 207 bp, Homo sapiens
agcatcctgatctttactccggctctgatctctcctttcccagagcagttgcttcaggcgttttctccccaccaagcccccacccttgctgtgtcaccatcactactcaagaccggaggcacagagggcaggagcacagaccccttaaaccggcattgtattccaaagacgacaatttttaacacgcttagtgtctctaaaaaccga

SEQ ID NO: 1068 - DNA, 127 bp, Homo sapiens
ggacccaggcccaaaccagtgagattaatctaccaccctgttggctgacgtttcacgtgtatctggtttgtttgttgttttgttgctgttgtttttaagatatgggttatctctttgtcgctcaggc

SEQ ID NO: 1069 - DNA, 64 bp, Homo sapiens
cacttgttttttgctcctccaagtccacctaatggtgataagagtgtcttgagtatctgtcctg

SEQ ID NO: 1070 - DNA, 238 bp, Homo sapiens
tctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttca

SEQ ID NO: 1071 - DNA, 251 bp, Homo sapiens
ttacaggcatgatccgtgatggctgtccagtttctagtatctttatatgtgaaaatggggctgatgatacatacccaacctatctcaaagggcatcttgagaagatggagagagaatcatgtgaaaaagcactttgaaaattgtaaaactccctacaaatgtaagatattgttaatgaccttacaaaaaccacctttttaaaatgatttggaatcatagactctaaaagttgattctagtggtctagtcca

SEQ ID NO: 1072 - DNA, 102 bp, Homo sapiens
gaaaaggctttgaagtgtctgaagaggagagacagggaagtgactcacagctcaacagcttcaccctctggctttgatggtccttggctccgtgatgctcag

SEQ ID NO: 1073 - DNA, 99 bp, Homo sapiens
catcccacaacaaggaacggcgttccaagcgggatgagaaactagacaagaaatctcaagccatggaggagctaaaagcagagcgagaaaaacgaaaga

SEQ ID NO: 1074 - DNA, 178 bp, Homo sapiens
agggtactccaccagcgaggatacaccgagccgacggggatctcggtctcggcgccggaagcctctgagagccgaatctggaaccggatgtggctgcttcctgccccgccccctgccgagggggcgggaatcgagggcccttcggaaaacccggccgggatttcggtcagctacattc

SEQ ID NO: 1075 - DNA, 129 bp, Homo sapiens
atggcacgcacccaagtgctgggcattgtgagagctttctctgtgccgggctctgcttgtgaacaagagccctctgagacagtgatgggaaccatctgcatcacagaagcacaagctctggtgatgatg

SEQ ID NO: 1076 - DNA, 160 bp, Homo sapiens
tgcattcttgtttcccacttgcagatctcccaagagtcccttcgaatttacctatacgagtttcagcttcccgcttgccacttagcttgataacgactcaaaaatcattcccttgttttcaagggctcttctttcttgtctgctctgtgtactacagggc

SEQ ID NO: 1077 - DNA, 40 bp, Homo sapiens
ttcttggatgatgtgacagtggcggataatgcagaaaagg

SEQ ID NO: 1078 - DNA, 98 bp, Homo sapiens
ttagaagggctgtcctgcatgggctcagtatggctactaacagttattctcattgttgagtaaatagagttgctaggcctgtctagtgtaagcattca

SEQ ID NO: 1079 - DNA, 101 bp, Homo sapiens
ctatgactgtgacttaaatgcagccaatatatttgaaagactagtaaatgatctatcaaaaattgctcaaggaaggggcagtcaagaacttggtatgagta

SEQ ID NO: 1080 - DNA, 173 bp, Homo sapiens
aggctgagaatgtggatcgtcctccgaagacgctgtccagggaagacctggagtgaatcatgggccaagggtggaggccaagttacggggacagagaggcgaagacaagggcagcagtgcccacaacaggaattcctacccttcaactttgttcatagtggtccctactttta

SEQ ID NO: 1081 - DNA, 33 bp, Homo sapiens
catagtactctgaacatgcccgatttcatctgt

SEQ ID NO: 1082 - DNA, 267 bp, Homo sapiens
ttccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctgg

SEQ ID NO: 1083 - DNA, 325 bp, Homo sapiens
gggtcttgcagccaggacaatcctgtttggaaacccgtatgaactctctcacattcatcattcacttcctggagagacagattttgtaaactttacagagcagcttttaatcattcggtggttcccagattcctaggccagagtctctatactgaataatttataatagaggtcatatccatcatggtggcttgaattctgtcctcccaagaacacaggctcaagtcctgacccctcctacctgtgaatgggaccttatttggaaatggagtctttgcaggtgtaattcagttaagatgaggtaggcccgaaaagcaatgactga

SEQ ID NO: 1084 - DNA, 118 bp, Homo sapiens
ccaaacatcaggctgttcacaaaaataacccacagtatcaactttagaaaacaaatcttaagactataacactaattatttttctagaggatgcatttgacatgccaactctcattca

SEQ ID NO: 1085 - DNA, 36 bp, Homo sapiens
ggagcccggctgtggtacagaaatagtgtcctccca

SEQ ID NO: 1086 - DNA, 39 bp, Homo sapiens
aaccactgcactacctgactcaggaatcggctctggaag

SEQ ID NO: 1087 - DNA, 43 bp, Homo sapiens
tcacccacctgccaaagccgcaaattccgcagctggtgtcctt

SEQ ID NO: 1088 - DNA, 58 bp, Homo sapiens
aggaggcgtggctatggaagagggcgtctccggagggggcgtggtcaatggcgaaggt

SEQ ID NO: 1089 - DNA, 118 bp, Homo sapiens
ccacatcctgatctgagatccagcaccccaaaaccgaactcctctaggtcatccccaaggcctatttgtgcagcagtgcttgttccctggagttctggggtcccagacggagtgtggt

SEQ ID NO: 1090 - DNA, 104 bp, Homo sapiens
ttgcttcactctaccggacagacggcagcagtcccagctctggtttccttctcggtttattctgttagaatgaaatggttcccataaataaggggcatgagccc

SEQ ID NO: 1091 - DNA, 45 bp, Homo sapiens
aaatcctatttacgggaattgcctgaacctttgatgacttttaat

SEQ ID NO: 1092 - DNA, 138 bp, Homo sapiens
cgccaccctcctgtggcgaaggaggggaagtgggagccgggaagtagagttggccttttgcaggagagtctggagcccctttctgggtgatgcattgggggccatagaaggatttggctgccgctttggagcatggat

SEQ ID NO: 1093 - DNA, 199 bp, Homo sapiens
cgtttctgcccgacttgcagtttcagggcatgccaggactgcagcaccctctccgtcctcccccggaaacgactttcaattcacctggaggctctcgaggctcccccgcgggcgggtagcgtgacagtgggtgcagaggagagggaggagcgcgggaacggcggcggccccagtgcgcctcccgcttgcttggcgagaa

SEQ ID NO: 1094 - DNA, 35 bp, Homo sapiens
ggagaccctgaaagacatcgtggagtattacaacg

SEQ ID NO: 1095 - DNA, 35 bp, Homo sapiens
ctaaggtttttggtctgagcggcaaaggacagagc

SEQ ID NO: 1096 - DNA, 120 bp, Homo sapiens
ggaaatggccacatgtgaaccaccatcccctgcaagggcagggattctgtgcaacccaggaaaaggctacacatgacccaccacccctgcaatggtgcattcacttgcaggggatggaga

SEQ ID NO: 1097 - DNA, 68 bp, Homo sapiens
gtgccattgctccacctgaagtcactgtaccagcccagaacactagtctgggtcccaagaagtcattt

SEQ ID NO: 1098 - DNA, 297 bp, Homo sapiens
tctgcccttttcatcgatgtgaaggctgggttagcaagttgaagtttatcgtttcgaagctgagggatgcatagactgcagtggtgttaggaagaacgctgcgtcaccgcagctgaaccgaagagcctccgagaggttctgtgctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactg

SEQ ID NO: 1099 - DNA, 274 bp, Homo sapiens
tagagctagtcgtccttgtaaattcagagttgaaaaatgtaattcaggcattaaatgctggggagccatagtagagaagacagataatcaccagctccaaagcacagtgcctgggcgggcatattgtgtgtgctgagcatcccaccgtgcaaggcagtgtttaaagctgtgaacacacagatgcagggactgtggtctcccttttcatggtgttctcacccttcatggcatccttggtcaaggtagggaggccagagagagctataaagatata

SEQ ID NO: 1100 - DNA, 85 bp, Homo sapiens
gtcaagagacacagttaccattcttgtgcaggcctccagaaacaacatatgaacaactaagcaaacacggctaagctctttccct

SEQ ID NO: 1101 - DNA, 262 bp, Homo sapiens
aacatagccctacgttccatgaacactcagtaacatcatcaaaacgtgatgcaattaaattttaccaggtttactgctgtcctgatgctttccaattttttttgacaacagttttgcctttttcaaattcaaatggtataattggggcttggtagttgatgtttatcttaattgaaacagattctcttcatccttttgctctgagactcccactttgaggctgaaaggtcattttaaatctgcagagcactcgagaagccac

SEQ ID NO: 1102 - DNA, 230 bp, Homo sapiens
ggtcattgtctttcctgtctcagtagtaatcaatcactgcttatcttcaaaaacccagagtaggggatggggcagttagtggggacagagggcagatgggtaagattcagagcacaggctagtgtgacggaagtttaaacttgtgagttaaatagggtttggcaatctagctggatagcatccctgccccttgaagagatgtttttgtggcgccacactactgacttagg

SEQ ID NO: 1103 - DNA, 95 bp, Homo sapiens
ctctgcctaaacctaggagtaaggttcctggagttgtgtctggagccatgtcaggagctgtgcttcaaaatgtgcctacaagtgcagtctgggtt

SEQ ID NO: 1104 - DNA, 41 bp, Homo sapiens
tcagccgcctgtggacatgcgcaaagggccctctcctgagt

SEQ ID NO: 1105 - DNA, 36 bp, Homo sapiens
ctggattctgcagtatgaacagggcaacctcaccaa

SEQ ID NO: 1106 - DNA, 58 bp, Homo sapiens
aagccaatgctgaggtgatgcgagagatgaccaagaagctgtacagccagtatgagga

SEQ ID NO: 1107 - DNA, 314 bp, Homo sapiens
tgaatataatatacggggctgtggagaaaatatttgtaacattaattctatattgtttattccagccttttaattacaaattaaaacatgaacattaccatacacacagaactaaatataatgcaaaaaatctacttctttattttcccacattctgtattatatatatgaaccaaaaatgcacagagaggcctaagttccccagcctgtggcacattgtcagggggccaagcatggtcgggactgcagggcctttcttgggctaggattgcccacgtggttatgactgaggattcttatgctctcacccacga

SEQ ID NO: 1108 - DNA, 105 bp, Homo sapiens
cgctgggatatgaagcttcgtcatcttggactcagtaaaagtgattctagcaatagtgattccactcagagtcagaagtctggcaggaactcgaacccccggcaa

SEQ ID NO: 1109 - DNA, 161 bp, Homo sapiens
gccataggccctgatgacccaaaaccccaggcttatgagaggctccagacctccatactttcacaatgacagttgtatcaatggtgtttttttccactaagcttatgtggccatgacatgaccaggacttcctgggtaagaacggagatgggaaacccatg

SEQ ID NO: 1110 - DNA, 60 bp, Homo sapiens
cctctttgacgtgggacatgtgacagagcaactgcaccaggcagccatactggaggccgt

SEQ ID NO: 1111 - DNA, 47 bp, Homo sapiens
gtaggaaatgctcttggtcacatcagaactctagatctgggggaata

SEQ ID NO: 1112 - DNA, 174 bp, Homo sapiens
cccggtgaagtacgcatgtgagctcatccaatctgcagccactccaggaggagggcatcattatcctcaataaacagatgagcaaacagaggctcatggagggtcagcgacgtgtccaaggtcactgactcatcagaaggctactttgttctcactccatcaggtggcccaagg

SEQ ID NO: 1113 - DNA, 327 bp, Homo sapiens
tgacagcatgcacgaaagcccgcttctcacatctgattccaggagaaagagcggcgtgtccagcaagataagtttatccaccatctcggggaaggtacagaaaaactgtgaggatgccaaaaggggagaatgaatagggggaagaaggaaaggacactcccgcctttccctggggaccctggagttccccgaaacatcttttaggctggggggagggtgctgaccaagaggccagaggagaatcttctatctatggtgtgccttcccccaccacccctaagtctgcacccagcactgagctccagaccttggtgatggctggactcc

SEQ ID NO: 1114 - DNA, 70 bp, Homo sapiens
accaacccacggtctctggagcacctgtggaattcgactggactggctccagcttttacagtctctctga

SEQ ID NO: 1115 - DNA, 191 bp, Homo sapiens
actgcgtaaggcaagaacgtctctactgtgacttcacctagtcactgtatctcagggtgcagctactggctgtcatcatgtccactctacagccagcagcctaatcagctttccctgcagggagtgcgggcagaatcagattgccaggggtctcccgggtggtgctgttaccctgggcgtgagcacaagct

SEQ ID NO: 1116 - DNA, 107 bp, Homo sapiens
ggccttcgatgctggcactgtcttggcgcctggctctacatcatgacagtgtgacaaggaagacaggctgcctgctgaccatctttgggacagagaagcttaatatc

SEQ ID NO: 1117 - DNA, 263 bp, Homo sapiens
agctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctg

SEQ ID NO: 1118 - DNA, 47 bp, Homo sapiens
aatcagtgttgcctggtggatagcaaatcaagtttcaaggttacaga

SEQ ID NO: 1119 - DNA, 86 bp, Homo sapiens
agaggaagcgagaccacaggaactaatgggggcccaggtggagaggcgaagtccggaaaggcagacagcgggtcggaagtttggtt

SEQ ID NO: 1120 - DNA, 212 bp, Homo sapiens
tggctttccctcttacaatgggtactcactctccacaaagggttatgcccacaggacaagaatgatactgaaacactactttgctattttactttctttacttggatctcctttccaactttcccttcaagcatgttgggccattttgatcgctggtgagcacatgtgagtcggggaaccagggcaaaggaagcagtactggatccttttcc

SEQ ID NO: 1121 - DNA, 409 bp, Homo sapiens
gcacatgaacagctacgccgggttgggttgggaaagagtcggaaataggggatgctctggtcaggagtgggaatgaaatgttgactgttccccctgctgctcagatctacctttgtcctttagtggtgagccatgctttgccctaccgtgttagcctgcaagaagtggttttgccggaccagcacttcccgccctccagggatcttcccagccctctgtgaagtgctagatgcttctccactggtctgcgggctggacccaggcctgcagtttgccatacttgcgcccctgctgtttgggaaggatctgtgctgtaagcctcgcggccatactacgactgtcagatctccatccctatgggctataggatggggcgacggcaccctatacctcagggacttgctttgga

SEQ ID NO: 1122 - DNA, 198 bp, Homo sapiens
agcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactg

SEQ ID NO: 1123 - DNA, 103 bp, Homo sapiens
gccatgttgggaagccgcatgactcgtggacaggcggggaaaaagaattgtcacatctatgtggataacttaccttcaggtatcccaaccaaggacactgagg

SEQ ID NO: 1124 - DNA, 130 bp, Homo sapiens
tgtagctgtattagacctcactttttaacatctgggacatgctatggggtggaggtgggaggatgacatgaaatgtaattaaactaaatggtcaaacttcaaagaggtcaaatgcttacagtagcctgca

SEQ ID NO: 1125 - DNA, 117 bp, Homo sapiens
gcccagacacaatggggcgttagtagaagtccagtccctatccctacccgaagaaagacaaaccccctggcgaacatctcatgcaataaaatggaggataaacccttcagcataatc

SEQ ID NO: 1126 - DNA, 1492 bp, Homo sapiens
tccctccagtttgtcgcatttaatcaaggagcggttgtagctgcctacgattttgtagaaaattgtgttggcttgagagcaagtcctaagttgagctgtccaaaagcaggtggttggttcgtttgaatttctgctttcagaaaggaaatcgatggggcgtgttgtcagaagttaggggcctacctcatgcatttagcttattttattccatttcctttacctggtgttaagttttctgtcttcagaataagaacaagtgactactgtctttattaagtctcttcggtctttttggttgctgtttggtgacaatggaaaatgggttgaatctattgtgtaatgttatattttagggaaagtcctaagtgcaaaagttaaaaataattttgtgtgtctaatgacattgctttgtacgagtcacaacatggaaatatcaaaatagctagtaacttctagaaagcaaaggaacttctgaaattagtggcttaccatttttgaagattttttttaacataaaacaagatttcccacaaaatcagtgtattaagatacataaaatacattgtgtcgaagagttaagatgtgtgagaagactggctattttgttacaaggtcctgatagtaagacattgagacaaaaaaccttgcaaaacattggtatacataaaggctgatcacgtgactactgtcgtccaaataatacataagtatccaaacctgtttccatgggaataggtttgtaagcttgcggtaacatcggacttaaatacacttttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgatttttttttttgttttaatccatttgggttcacgtcagatcatcggta

SEQ ID NO: 1127 - DNA, 41 bp, Homo sapiens
gcccaagtgcccctacaccagagcacctcttgctttcagca

SEQ ID NO: 1128 - DNA, 240 bp, Homo sapiens
aagtcaaagccctagcccgcgcttggcccctgctgccccctagtggccatatgctaggaggcaggcctgctgcctgggcctgtctggcctgggccctgaagtctgttttccctttggtgcctcctgagcccatttcccactcaccttttccttcatgggtccctggtgatggcaaccccgtctccacccctctgtgggattctgccctgcctcccgcacccatggttcatgaccctgttt

SEQ ID NO: 1129 - DNA, 71 bp, Homo sapiens
cccgcccgtgctctgttgccgccgccccttcgcagcgtcccgcggctgctactcacaatcgcgcccccact

SEQ ID NO: 1130 - DNA, 259 bp, Homo sapiens
gggccgccctgaacatgttgtagtggagcttccgtctgtcttcagcttccgtcaacactgaaccagctcatctaagcaccagacacaagattttactgcttttgtcaggtggagtgggaagtcgcacccacgtctggccagttgggtcggctgtaactcagactttggactgacttgtcacccagctcatatagcaaggagttcctgatggcagctgggggagctgacatcagtgtcagctcagactcttaggcagtta

SEQ ID NO: 1131 - DNA, 640 bp, Homo sapiens
gaagctttcatttgccgggacactcgggcccatgggattgcacagagctggagggaggggtgagataggggcagataggagctgcaggggtgcctggcgagcctctggttttcctctgctcctctgcctgtcctctcccaactcaaggttctagtgggaaggggtgcccccaggctctcatgttcctggcgtgagatgaaaggatccctgcggagggtttggttcttgagggctgggggtggacttgggaacaggctgtgtgtttgtcccagcgatggtgcctgcttagcttcccgtccccaccccccagccccttggccctctcctgtctgccctagggagaaggcaggtggacaagggcccatgaaaaaatacaggtgtctagactgccagggagaccctggcccccagtagtgtgtcctggggacttcctcagagcgagaaacctcccccaatgtcttcaagacttttctctccccccgcccaaccccgtctctccctcccttgccacccaaatgttagaaaaatagctgtgaacagagagcgcttttgtctgcaatggcagcaggatctggacggtcccctcccctaagttcccccctccccaccccacactctgacagcttgttccgtgttgccc

SEQ ID NO: 1132 - DNA, 225 bp, Homo sapiens
aggttatttgaagccacgtcctgcagcttcaccttctctttagggttttagaagtcactactattctggcaggcactgtcttgtctgactatgaatagcgtattggcttcatgctcacaaggacaggggcatgagctcactttctacaaggaccagtgagctgtcctcggttcagggacagcaccctgtgccgtcattgcacttggacgctgttcaatgtgcata

SEQ ID NO: 1133 - DNA, 39 bp, Homo sapiens
aacagtccttacttatgcctccttgcaccccagtgttaa

SEQ ID NO: 1134 - DNA, 84 bp, Homo sapiens
taaagtaagcatattgtcaaccttcctcgctcctttcaagcacctgagtcctggcatcacaaacacggaggatgacgacaccct

SEQ ID NO: 1135 - DNA, 159 bp, Homo sapiens
ttcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctg

SEQ ID NO: 1136 - DNA, 95 bp, Homo sapiens
agattccaggcttcaagatcagaggcagaactctcctgcagggaataaagaaaatattaaacccaatgaaacatcacctagcttctcaaaagctg

SEQ ID NO: 1137 - DNA, 171 bp, Homo sapiens
aaatgacagatactggcgaggctgaaaagggaatgcttatacaccattggtgggaatgtaaattagtccagttattttggaaagcagtctggagatttctcaaagaacttaaaacagaattaccatttgacccagcaatcccattaccaggtatatacttccacaaaaata

SEQ ID NO: 1138 - DNA, 125 bp, Homo sapiens
gctttgggagacattgaaattgctattaagctggtgaaaacagagctacaaagcccagaacacccattggaccaacactatagaaacctacattgtgccttgcgcccccttgaccatgaaagtta

SEQ ID NO: 1139 - DNA, 31 bp, Homo sapiens
ggaggcagagctgaaaacagggttggaagga

SEQ ID NO: 1140 - DNA, 87 bp, Homo sapiens
ctggctggatctctgtatgcaattggtggttttgctatgattcaactggagtctaaagaatttgcacccactgaagtcaatgacata

SEQ ID NO: 1141 - DNA, 61 bp, Homo sapiens
gctgtttctgttgatcccaaccctacatcagaagggatatcgtcgtggctatgataactag

SEQ ID NO: 1142 - DNA, 103 bp, Homo sapiens
gacttcacccgtgattcacctggtgacagatgccaagggcaccgtcatccacgaagtccacgtccagatgcaggagctgtccctgggcatgaaagccctggcc

SEQ ID NO: 1143 - DNA, 44 bp, Homo sapiens
gccctgcatatattatctatgactaaccccaaaacagacagctt

SEQ ID NO: 1144 - DNA, 550 bp, Homo sapiens
tggggccatgtctgatgaaagcttggtgatcccttttgggtcaaaaacaagctctgactgaagagatgcaagattttctcagatgatttgtgtgtcagtcagagttccgccagagaaacacaaccagtaggatatattctatcttgtctgtcttcatatccatgtatctgtcatctacctagatttaatgcaaggaattggtttatgcagttgtaggggctggctaggcaaatccaaaatccacagggcaggccgtgtggaagggaggtctggaaactctcagacaagacctgacattgcagtccactggtggaatttctccttcttcagggaaacctcagctttcaacggagtggatcagacccaaccatattatccaggataatctcctttacataaagttaactgattgtagatgtaaattacatttacaagataccttcatagcaacacctaggtcagtttttgaataactgggtattatagcatagccaggtcaacacgtaaaattgatcaccacagtccatgtcttgttaacttggcacctgta

SEQ ID NO: 1145 - DNA, 412 bp, Homo sapiens
tggccagctcgccttgggaaaccacccatgccatcatcgtgcatatgatctaatggctttagagaactaggaacagagttattccccaacaaactgactgggaacctgttctgatgagtattttaatttgtgtgataaacaatcattttgagaggctggggtttgccatttccccttccaagaggaagtgcctttacgcatttgaaacttgacatgccatgaaggtatttttggagggcaggggacatttgggaagtcatgcagattacctaaggcaagtgatacttgcgtttatggtgcgtggggaatctgtaggcacagaaatgagactcagcagcagaggacagacagcacctgcctgccttctggtggaaactcagtggtgacgggagctttgctcattgcctttttc

SEQ ID NO: 1146 - DNA, 68 bp, Homo sapiens
atcttacggggaggctgtctccagacaaccagcagcctgggctccaggacgacgccaaacccacaggc

SEQ ID NO: 1147 - DNA, 98 bp, Homo sapiens
tgagtacagcccactgattgacattcaagacccattggaaaaatcaggagacacaagagtgggaagagtgcagattggagcagctatccaaaaataca

SEQ ID NO: 1148 - DNA, 84 bp, Homo sapiens
atcagatgcgcccatcaattattttttttgacgaaattgatggtctggctccagtacggtcaagcaggcaagatcagattcaca

SEQ ID NO: 1149 - DNA, 59 bp, Homo sapiens
ctccatgggatggtatccgagtggcttggaaaataatatttagttgtgttcacccacct

SEQ ID NO: 1150 - DNA, 86 bp, Homo sapiens
actttctacaatgtggaggaggctggtgttggggggccatggcccctgagagcccccaatgaagcccttaagtgggacagcagtgc

SEQ ID NO: 1151 - DNA, 66 bp, Homo sapiens
accagcaaacaagccctaaggtggacaagtgccacagcgactcaagggcacctccatcgtggtcca

SEQ ID NO: 1152 - DNA, 107 bp, Homo sapiens
gggtacaagactagacatgactgaaatggatttgggttttttggtgacctcccttactgggctaatcagcacttgatcggaagtccaggttagtatgtgaagccagg

SEQ ID NO: 1153 - DNA, 174 bp, Homo sapiens
cccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatct

SEQ ID NO: 1154 - DNA, 154 bp, Homo sapiens
cagaagattaggctctggttaaacatcttctcctgagggcagacattgttaagaacgatattctggcatatttcaaaattgttccttttcccctctggctgccagagcatgagggattttccttaatattcacctttggaaccttgtagagctt

SEQ ID NO: 1155 - DNA, 320 bp, Homo sapiens
taggcaggcctgtgcaaacctatcccctaaatcagaggaagctgaggggctgaaggaagaagctggcaaattcagtttctcagaaagaaacacttaataaggccttgccaacagaagccctgtctgtgtcttggatggtagcgagacaagatggtggatccccagactcagggcttgtatacatagggaaggggcatacatgcttcagaagggatgtgcagaacaattgcttagggtcgggatctatggtaagtaagagaacatcaaggctgtttcaccaaagggcaggatttacgtgatgtacgtgctcttacacaaga

SEQ ID NO: 1156 - DNA, 136 bp, Homo sapiens
ctactgaaatctgcggtggggccaacctgtcctgctactgtgagttccttagtcaagcctggccttaactgcccctcaataccaaagccaaccttgccttcacctggacagattctgaatggcaaagggcttcctg

SEQ ID NO: 1157 - DNA, 117 bp, Homo sapiens
tccagggcctgtttgcgcttccctttggtaggacagcaaagccagctcatatcgcaaaggttaagatgaagtttcgcttcttaggaaaattaatggccaaggctatcatggatttca

SEQ ID NO: 1158 - DNA, 149 bp, Homo sapiens
tgaagttcttgagagcatcccagctctctctctgtctaagatgtcacatccctcattacatctcaatgtccctctcagcctgcgctcccaggctccagatacagctgcgaagcctctattacaaacatattcctttgccgatgctgacc

SEQ ID NO: 1159 - DNA, 48 bp, Homo sapiens
gtccgcgcatctttaccgatgcatctccactcatatcagtcctcactc

SEQ ID NO: 1160 - DNA, 90 bp, Homo sapiens
gatcctcctatagttcctcaatgtgatgactgggtgttcacactcattggcgagatgtgcctctctcaaaccttgttcagatgctgcaga

SEQ ID NO: 1161 - DNA, 845 bp, Homo sapiens
acttgcattgtgctagggatctgccctatatctttgcctctggtgtttcgttgttgttgttattgtttgtttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttcttttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtcta

SEQ ID NO: 1162 - DNA, 507 bp, Homo sapiens
ctttatcccgtgaggagcacgcggaaacctctacccatgcaggatgtttctaagaaccacttcttccctgtcttaactaagaaggctcccacagctggtgccaatcaggtggagaacatggcaagtccccgaaatgcacttccaaagacaggaaagattgcagtgggacagaacccagaaaatctctcacattctcgaaaacccgaaagagaacctccaagaaagacgtttgcctctcctccacctctttatctcggcgggagaggaagcctcgcccccattcatcccgccccttctccccaccccgccgcagggagaagtttaccatggctgcctgcggccccttcacttccggtgccggtgccgctagggctgcgccatccccccagtcaatcggacaaccatagcctccaactgacctttctgacagctctgagactcctccggccacgactaggtgctgtcctggaggaaacggtggaggacggccgcacaaaaaccaatcta

SEQ ID NO: 1163 - DNA, 52 bp, Homo sapiens
ccttcaagctggaggtcgtggctgcagaggcctctacccgacaaagcattag

SEQ ID NO: 1164 - DNA, 28 bp, Homo sapiens
ctgcagtgtggtgaactccaacttttag

SEQ ID NO: 1165 - DNA, 81 bp, Homo sapiens
gttacactgccttcaatggcgtggacttcgagggcacgttccatgtgaacacggtcacggatgacgactatgcgggcttca

SEQ ID NO: 1166 - DNA, 373 bp, Homo sapiens
ccacaccatggtttcccaatagttctctttttggaggacttttcaattgatgagtaaactgctttagatatttcagaacttcattccccaaatgaaagctaatctggacaaactatatattgcatagatttctctacagattctttgctttaaaacctaaatgcaactaacatagtgtaattttaacctatttgccccacagtaaaaactatctgtcctgaaaaatatgatggatatatcctgtgattttccagttaacagaattgttctacttcaaagataattattatcatatatcaaaataaccagctcaacataggacattacttcagtctttactgactcataggcatatgaacttgtgcccagcttt

SEQ ID NO: 1167 - DNA, 218 bp, Homo sapiens
ccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttaga

SEQ ID NO: 1168 - DNA, 37 bp, Homo sapiens
cccggggcccatagcccacaccgtgccctgcgtttca

SEQ ID NO: 1169 - DNA, 186 bp, Homo sapiens
caagctctggtgattgaggaacagctgcgccgggctgcttacttgaacatgtcagaagacccttctcacccttccatggccctcaacacccgctttgctgaggtggagtgtttggcggaaagtcatcagcacctgtccaaggagtcaatggcaggaaacaagccagccaatgcagtcctgcacaaa

SEQ ID NO: 1170 - DNA, 162 bp, Homo sapiens
tcaggccaagcagtcccagttcatgtgtcttgtgatcttggtgggaaggtgcttgaactcccagagttctaacttctgcagctaaaacacaggaccctagctgccttctcaccccagctagtggcaggcctcagtaaatgacagaacagtggaatgctcctc

SEQ ID NO: 1171 - DNA, 145 bp, Homo sapiens
gcagtgtagccaatcaagtattccacccagtgatgtttgacaaatgcattcagactctaaagaagagctggccccaggaatctaacttgaatcggaaaagaaagaaagaacagcctaagagctctcaggctaaccccgggaggca

SEQ ID NO: 1172 - DNA, 115 bp, Homo sapiens
ggagacacaggtattttggtttctagaagtgagtggcttaacatacagctggaaaaaatctctaggtttggtcagagtctacatgaaaacagaccacaaggacagccaacatata

SEQ ID NO: 1173 - DNA, 467 bp, Homo sapiens
ccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgatt

SEQ ID NO: 1174 - DNA, 1183 bp, Homo sapiens
tgctggctacaatttggaactgtgcagtttaaatatttatttattttgttttgtttttactctttctaatttggatattaggttttgcttcatctgtgttttttttctcttactcagtcaataaccatatctccaaactaaattaacgttactaaagtggggaatttccccttcctatattctcataagtgattgagcatctgtcctcatataggacttgctgccttggaggggaggggccagacctgggaaaaagaggagccatgaataactctgcttcctacatttggcttcttctcttcctccatatccatgatttatatatgtgaaggaagaacaagaaataacttaataggccatttgtcaatgagagtacagtgtaggaagggtggaaagtgaatataaaatctagattggggcttctggtttcctgttcagcctataaggagcttagaatttgccactcagtcttgacaacaagtaaaatgctgaacaaactgaaaaatcaataattcttctcagatccataagagaagtgagattacagggcaaactactaccttcagcatcaccccgcacccccaaccccactaaatagaaagacaggagaatacagagaatcataacacaggcgcagaaacctccttgagagagccagggtagataaacatgaactgtaattgatgaattcctggaggatcactgtggatgacctgaaggattaaaaactctagagggactcactcaaaggagggcccaagcttttgtgattttttttttttttttttttttttttgccacctgaagctctacaaggttccaaaggtgaatattaaggaaaatccctcatgctctggcagccagaggggaaaaggaacaattttgaaatatgccagaatatcgttcttaacaatgtctgccctcaggagaagatgtttaaccagagcctaatcttctggggttttctgagagcctcattgatctgggggaagggaaataccaactccagccccttctagccttccaagtggagaaagagaaacaccaaattctagcctcctctagctttcaacttggaagaagggaaatacccagctccagccccctctagcctttctcccctagttcagaggagagggatagagaagcatttgtgaagttcaccgtttagagacataggttc

SEQ ID NO: 1175 - DNA, 224 bp, Homo sapiens
atgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatc

SEQ ID NO: 1176 - DNA, 130 bp, Homo sapiens
aggaagctctgtgataaagttgcccttctttctaatgtgcttcagcatcattcttggaatttttatttgtttgtttgtttctgatggagattatagttttgtgacagctaggcccttgtctgttgtttca

SEQ ID NO: 1177 - DNA, 43 bp, Homo sapiens
caagggagggctccgaaaaggacatggcgaagtggcaaaaaga

SEQ ID NO: 1178 - DNA, 353 bp, Homo sapiens
gggtgacttcactaagtcctgaggagggaggaatagatattaccaaagataggagatactgatgtatacaaggtaattgcagttgacaaagagtaggtgtggctaattggagcagattatgtccatggtgtagtggattttatgcgttttttaacagaagaaaccacctcaattttttttttttgaggttaaacttcagtatatgaaagagggggcaacccagcagttgttttgattgaagcagagttctaggtctccaggaatagtttaaaaactgtaactaggctgggcacgatggctcatgcctgtaatccccaacactttgggaggctgaggtcgaaacatctcttgaa

SEQ ID NO: 1179 - DNA, 630 bp, Homo sapiens
cagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaa

SEQ ID NO: 1180 - DNA, 125 bp, Homo sapiens
agacagtgcacctgtttcctgtttgggagaacaccactccactccatctctgccagcggatcctggctccctacctgaagaaagcgcctcgccagcaaggtgcatgatcgtccaccagggcacca

SEQ ID NO: 1181 - DNA, 35 bp, Homo sapiens
cagagagggtccgtggcatgtccaaggttactctg

SEQ ID NO: 1182 - DNA, 51 bp, Homo sapiens
acgggttgaagatccgagaggctgagtcacttccacaaagtaacacagctg

SEQ ID NO: 1183 - DNA, 107 bp, Homo sapiens
ctggctccaatggtgacccaaggtctccagactcccttcattacatcagccccaatggcgttaatgagtatttgactgctctctggtctgtgggactggtcattcaa

SEQ ID NO: 1184 - DNA, 32 bp, Homo sapiens
gggcgagcagccctacgagcacctgaccgcag

SEQ ID NO: 1185 - DNA, 30 bp, Homo sapiens
ccatgccagtctgagcactccatttaatta

SEQ ID NO: 1186 - DNA, 314 bp, Homo sapiens
caccaccatggggttgtcctcaatgccacggaacagtccccgctccttcagcgccaccagcaccgctttcctggcctcaaacctgggcaggccctgggtaggaatgaggcctcatcatggcgatgcccagccatccctccatctccctgacccgggcactcttgcctcaggcagcctcaccaggaaaggcggaggcacattgatgagggccccccgggagtccatgatgctgatggcctccagcccgtgccgctgcccaacttcatagtcattttggtcatgtgcgggggtgatcttcacagcacctgggtgta

SEQ ID NO: 1187 - DNA, 142 bp, Homo sapiens
tccaccacaatttggccggtccagagactgctggcatcattaactcagaaactcagagatacaaacgctctacttatcttgccgggccctcagccagaagtctcctataactctgcggatgtttatacatgccctctgcttc

SEQ ID NO: 1188 - DNA, 253 bp, Homo sapiens
tgacacgacccgaaccgtgcgcctcctctgctctaccggctcttggctcaccggcaagctgcaaagcagagccaggcgtgcagggcacggggctggcccttttcccagctcggaaagagaaagaaaatctgcctacagctccttcgctccacgacccctcccccgactttggggggccgtgtgaacgcggcagcggcggcgtgcgtgcgctcaccgcacgagctggaatgcacgagtgcccattagggacgcc

SEQ ID NO: 1189 - DNA, 28 bp, Homo sapiens
tttagacatgaagtatgaggccggcatc

SEQ ID NO: 1190 - DNA, 157 bp, Homo sapiens
acctgaaagaaccaagtcgccacgactcccaagtgccacctcagtaagggacctcaacgggacgaccaaggcccagtggaagcctcgacggcccttgaccatggaagctgcccagagcatctcaaataagtcagcagcctttccactgggcctattc

SEQ ID NO: 1191 - DNA, 106 bp, Homo sapiens
tctcatggctgaaatccgatgaggcattggacctcctcacgcagagtctttggatgcttctgtctgagcctgagcagtgggccagatggactatcggtctgcctca

SEQ ID NO: 1192 - DNA, 818 bp, Homo sapiens
tgtgtgtggacactgcaaccctcccgaagctgggcctggaagaaatgacttccccagaaccttatctgggccggagaggggcgttggcagcgggggtcttgccgccttccggtcctctgcatgccaggcaccacctggggccgggccagggcaggctgcctggacaccatggacctgcccagctgtaggggaggtgtgtcctgcagccctacccgaggcccaggcctgcgtggctgagaggactgaggacggctgacccccttggtgactgcctgggcccagaggggagttgggggagtggtcagctgggtgtggccagccctgggggaaggatccagggactgtgtccacttagggataggaggcagctagcagagccctcccagctgaccaggggaggccctgtgggcacaggaggggccccaggtgtaggtacaggtgcagggctgtgcggctctgtgtcacccaggtggagcgtcttgccccgtttgatggctgacaaagtgcccttgaatgcgtcagacccagcgtggtcccagggtcctgaccctaacataccaccccaaattaccctcaccccagcctacccctgccctaaattcaccccaagcctccacccaaaccccttagtcccaacaccttaaccctagacccaaccctacaccccaagccctaatccctaaccgctagcctcaccctaaccttcctaccggatgccacctggcaaacatcctcctggcccctatctgcccctcccccggggatccgggaggcagtggggtccctgggaggctgctccctgcagaacgcgatggaca

SEQ ID NO: 1193 - DNA, 121 bp, Homo sapiens
ccaagtatggataagggccagtctacccattcatcacctccttagttgccagtcaatttccagtcaagtagcagtgggaatgaattatctaaaagctctctgctagcatacacgtgaaata

SEQ ID NO: 1194 - DNA, 297 bp, Homo sapiens
tttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtg

SEQ ID NO: 1195 - DNA, 82 bp, Homo sapiens
acccaatggatatggggactattaagaagagactagaaaataattattattggagtgcaagcgaatgtatgcaggacttcaa

SEQ ID NO: 1196 - DNA, 305 bp, Homo sapiens
gcagttcgtaactcctgactttatgaaatgtctgagaagccaggttcaatgtcccatattcctcattaataatttataacactataatgtgatttcgccctgtgggtggataggctttttactagggtaataacagtatggtgattccaaattatttgggtcctgagtttgaattcagcttgtcaggtgagttttagctttaatttcctaacttgcaaaatgggattaataatatcttagagggttcaatataaagtatcacgcagtagaaggtcaacaaatggggcttatgacgatgacagtta

SEQ ID NO: 1197 - DNA, 66 bp, Homo sapiens
tggccttcgcggtggcgatgctcttcttggaaaaccagatccagaaactggaggagtcccgctcga

SEQ ID NO: 1198 - DNA, 156 bp, Homo sapiens
tcagtgagctgagcatctgcatctcggggttctgttgtacatggggttaatactccatccgagtgagctgggcatccgcatctctgggttttgtgtgcgtggggttaacactccatctgagtgagctgggtgactgcctccatgagtcctgttgtg

SEQ ID NO: 1199 - DNA, 28 bp, Homo sapiens
cacaacgacagcacaaggctcttggctg

SEQ ID NO: 1200 - DNA, 293 bp, Homo sapiens
tttggcacatatccaaggcacattagaaaattagaaatcataaattactttgtagaaaaataatccctcccttccttctgtacatacacaagtatttccaagaacatggacaaaaccatttccctatcacaaggtcatttgaaaacggactcaggacaaacccatatacgtgtagctctaggccaataacataaaaataacagtataatctatagaaatttataaaaaggaataaatggcaataaattctaaccgaaagtaactctgacctggtttgtgctgttaagttttga

SEQ ID NO: 1201 - DNA, 100 bp, Homo sapiens
gtttcacgtgccacgatcatggtgccacggtactgcagtatgcacccaaacagcaactcctaatctcggggggtaggaaaggacacgtctgcatttttga

SEQ ID NO: 1202 - DNA, 50 bp, Homo sapiens
gcaggttgggccatactggcctcgcctggcctgaggtctcgctgatgctg

SEQ ID NO: 1203 - DNA, 32 bp, Homo sapiens
ggtggaagccgaagtatctcagcttcttctgc

SEQ ID NO: 1204 - DNA, 140 bp, Homo sapiens
tcgagtctaagacaccatgtcatggatttgaacaatgttgatggtggagactcagacaaatggggctggagaaacctaacctggctcatgaactgtccaaacgatgagacaagttgccctgacagggcagttgtttggaa

SEQ ID NO: 1205 - DNA, 129 bp, Homo sapiens
cccgctcgcatcctgcgcactgcgcgcccttgtacctgcaaagaaacccacgccctgcgccttcgctcaaggacacttgggggaagggcccctgattccctattcttcacctcgtgaagggcgggcatg

SEQ ID NO: 1206 - DNA, 28 bp, Homo sapiens
gttcttgagccccttcacgaccgtcacc

SEQ ID NO: 1207 - DNA, 224 bp, Homo sapiens
gggaatacggtcgacgagactcctccggtattcaacttcatgacattgtcctgtcatgtggaactgtagggaatagtggatgatggcgacagtggtgaaatatagctcgggctttaggatttgtcatatgtctaatgaggcttgacatgcaagtactattaaaatctccttagcatacattgttttcctgattactgggggggaccttaagttgtctcatgtaa

SEQ ID NO: 1208 - DNA, 92 bp, Homo sapiens
taatcttgttcgtccaggtgtctcagagtccagctatgttagacacactcagttaatattagccaacacaacaaatattctgctcccttttc

SEQ ID NO: 1209 - DNA, 374 bp, Homo sapiens
gcctaatcggattgtaagctcgtcgaggccgctggtctcttgctctcgaggactccatcccagcattggcagcctccgcctccccatgtcccaaaagaggaaactgggctggagaaagtttcgcagcccaaggacgcgtggctggaagtggcagaacccgggcttccgaggttgggcgagtggggtcctccaaggccctcagcacgggtcggagggattgggactgaacccgccatccccctggaccttggtgccctccaagccccgcgctcgcgccctgtccgtcgcctcccccagagatgctctgcagggacgatgagaccttggtgttccccggttctctgtcccctggcaccacctgaacgattgacatc

SEQ ID NO: 1210 - DNA, 2423 bp, Homo sapiens
atgggcacactcttggcatcaactctcttggtccaatggcaaccctatatattgcacacgggacactttctgtggggactctgagatgcagagggaccagataacaagcaggaaaggtagggcctggtgtgagggcacgagactcaccgacatccctgatgacaagcctgtaggtccctcgggctctctccccccagcatcgcacagtggagaaggtccagtcattgaagccgttgggatccctgaggaaagaacacagcagaaacaggtggaaggcgtgggccagagagctgaccttcccccagcaacactttcttactgtagtagccgtggaaacaacctgggagggtgccacgagggcttctcaggtgcccctttcccctggggtctcatggaaggaggaaattgtgttaacgtggtgtggtggaaaaagcaagcatggagcgcgcacaggcttggagtcccacggatctaggtttattcttgttctcttgggcacttactagctccatgacttgttttctttttctttctttttttttttggagacagggtctcactctgttatccaagctggagtgcagtggcatgatcacagctcactgcagccttgacttcctgggttcaagtgatcctcccacctcagtctcctgagtagctgggactacaggcatgtaccaccatgctcagctaatctttaaattttttgtagagacagggtctcactttgttgcccaggctggtcttgaactcctgagttcaagtgattctcctgccttgacctcccaaagtgctgggattacaggtgtgagccaccacacccagccagtttcctcatttgtaaaaggaggttacaaagtctaatctagggggttcttagaaggattagagaacatgtatgtgaggtgcagggcctagcgcttgaagaaggtatgtgacgaaaggcttccagccgccagggatagccagtgccacagtagtttaggacagtgccaggatccacttcttccatttcttttccctggaaaggcccttgctgaaaaggttgctcaggcctcgggcgggtgtacatacgagtccatgctgcggggggcgccgatgagggacatcatgccactggggcagaacagcttcagctccaagctgccgcgccgtgggtgagtgatggagactgtcactgccacatgctccagggtcttcagccctgacatctccaggtccatcctgctgactgtagaaagtcaggctgggcagctgggaaaccagcccacaaacacgccttcacttcacccccacgtacacaaagacacacgctcactgaagccacatacaaacatctacggcaaccctaactgggacctcgcctatactagtaaatggaatggagctgctgctctcaagtttacaacgtagcttcgagtgcagttgggaagacgacacatacccaagacacaatataagaatccagcagagcaacttcaatcattcattcatccaaaacattatttactgggtacctcctccatttcaggcactgtactagatgctgggaatataaagataagatgggcgtggtccctgcctcctacctgcaagtggaaaatgatatggtatgggaaatatacataattgataagggaagagaaataagtcagatgggtttaggcacacagcagtgagacacactgaaggaaatgaatacagatcggtagacagggttggtagagggcattctaggcagtggaaaaggcatgaacaaagacgaaatgcacacatctcactgaagatgatgcacagttaatttttaaaaaatgctggtggataaatttcaagcaaattatgtgagtgaaaaaagcaatctcaaaagaagcatatagccaggtgtggtggtgtgcacctgtggtcccactaccggggagggtgaggtgggaggatcgcttgagcctgggaggtggagattgcagtgagccatgctcatgctaccacactccagcctgggcaacagaacaagaccctgtctcaaagaaaaaaaaaaaaagaaaaaggatgcgtagcacacaattccatttaggtgatgttaattgaagtacctgcagtgatacataacagataaatgggtgccaggggccagggacaggggaggggatgggtgtggccagaaaggggtaacacaaaggagtcttgtgataatggaattgttctggatcttggttgtggtggtagttatgcaaggctacatgtgatacaattgcatacagctacacacgcgcatacacaaatattgacagcatgtgtatctggtgaactccaaataagctctatggattgtaccaatgtcaatttcttggttttgatattatactttaattgtgtgaaacattaagattgggagaagggtgcacgggacttctcttgtacatttc

SEQ ID NO: 1211 - DNA, 595 bp, Homo sapiens
atgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagta

SEQ ID NO: 1212 - DNA, 28 bp, Homo sapiens
ctgccactgcgaggcttccacccatgct

SEQ ID NO: 1213 - DNA, 108 bp, Homo sapiens
aatattgcagggttgagcaggtgcaatgttgtaatagaggtagcaggcctgagcgtgtgcaatgttgtaatagaggtagcagggctgagcgtgtgcaatgttgtaata

SEQ ID NO: 1214 - DNA, 29 bp, Homo sapiens
tagctcactgtcaactttgaacacttggg

SEQ ID NO: 1215 - DNA, 205 bp, Homo sapiens
cattatggtgctactgagcgttttcttttggtaaaaagaaaaatgccatgggctgcagtcttcttccatcacttttccctaccaggtccattaatatgcttataacactagtgccagttattttatttgataatgcttatggtatttgtatatttgtttgcattccaattttgtttaataatgagtgtgtaaactgcatacgtta

SEQ ID NO: 1216 - DNA, 31 bp, Homo sapiens
gtcagctggtttacgcgcctcaaactgttga

SEQ ID NO: 1217 - DNA, 140 bp, Homo sapiens
agaacctcctcatgtggcatctttacttattctcttcttggaaaatccatgtgacctccccgcgcttaaagtgtttccacgttacaggcgacttaaaggcagccctggagcctgacgtataattcgagcgccgatgcaga

SEQ ID NO: 1218 - DNA, 164 bp, Homo sapiens
gtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtcca

SEQ ID NO: 1219 - DNA, 140 bp, Homo sapiens
tgagacggtttaagcggaagcatcttactgccattgactgccagcatttggctcggagtcacttggctgtgacccagcccttcggtcaaagatggacaaacagagatccgaaccatggtctctatcctaaaccgagaaca

SEQ ID NO: 1220 - DNA, 40 bp, Homo sapiens
tgaaacagcccaaggacctgcgcttattgatcaaaatcta

SEQ ID NO: 1221 - DNA, 239 bp, Homo sapiens
gggtaggctctgttatccaaaaacagctgctgtagctcttgtcacgtcccccttagcggatgtgagaggcctcgtcctggaagtacatccacgcaggaccacggccttaagggcaggtgggagccctggagggtcctgccagctaccgacgtgagtgcctcacggagaacctcactggagacagcaaggagggacccccgtttccatcggcctctggcaaggctctcagtctaaatccg

SEQ ID NO: 1222 - DNA, 98 bp, Homo sapiens
tacccgatggatttgtgaggattaaattaagatatgtatacaataagacagggaagtccgacatttagtaactgctcgatgatcattgcggtacgtta

SEQ ID NO: 1223 - DNA, 105 bp, Homo sapiens
gacaacacttactacaaagaggcagaaaaagaaaatcttgtggaacaatccattccgtcaaatgcttgttcttccctggaagttgaggcagccatatcaagaaaa

SEQ ID NO: 1224 - DNA, 30 bp, Homo sapiens
ggtgctcgaggattgcccggaacagctggc

SEQ ID NO: 1225 - DNA, 492 bp, Homo sapiens
gtctgcattgaatagtggggatcccctcaacaaaattttcaggaggaggaggatatccctgttattttccagaataatcagtgatactctgtgatattgataatctaccttgttggcccttaccaaattactgggtgtgagtaacagctgactgtagctccctttctctaccctagtgctctggaaggaggaaaggagagctggcttgtatcttactttctcaagttatcagtccacaaacatgaagagtattagtgttacagatacaaagatgataactactgtcttatgagcctttattctgctaagtgtatccattatctcttttaatcttcacacaacccaccatcaatgaggtatatagtattcttatgttacacagcaggaacatctcagagattctgaaactggcccgtggttatacagatgggaagtggtagaggtcagattcagacacagtcctgtttgagtctgaccataaccttaatcctg

SEQ ID NO: 1226 - DNA, 68 bp, Homo sapiens
ctggtgtttccgagacggataactcatctcaggatgccttgggacttagcaaattggggggacaggct

SEQ ID NO: 1227 - DNA, 44 bp, Homo sapiens
tgagactaccaagacgagccaaaaccgcagcactagaaaaaagt

SEQ ID NO: 1228 - DNA, 192 bp, Homo sapiens
aggtgaagttcacaaggccagtgcctgcttccatggtgcctactgccaggcctgctattgcctttgagatctgactcagaacacaatgccaagagctttctattagatacaaacacccgactttggacactctgttactcaggtttttttaatccctcacatagaaaagcaccagagttgtcaccatacaga

SEQ ID NO: 1229 - DNA, 46 bp, Homo sapiens
atgtccctggctgtgtcaaggactgcccgatgtcctacacctcctg

SEQ ID NO: 1230 - DNA, 130 bp, Homo sapiens
ctgctaacaacggacccagccagtgcccaccaaatggctcctgcagccttcctttgcagccacactgaaaagcgatcaaatgtgaaatcccagggaggccagagcaatgcggccagcactcagctccggg

SEQ ID NO: 1231 - DNA, 85 bp, Homo sapiens
ttcagaagacgggttgtgccagcagtgagaggtccagggtacccaggggattcctacctggacatccctgatgaagtggggcctg

SEQ ID NO: 1232 - DNA, 49 bp, Homo sapiens
tgtgaccagcagtacagagagaactatactgtgtttgccaaaggggatt

SEQ ID NO: 1233 - DNA, 198 bp, Homo sapiens
tgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtcca

SEQ ID NO: 1234 - DNA, 102 bp, Homo sapiens
cgctctagtcaagggccaagccctttgccatcccctcctccagggagaactgaccagtccatccttggtgatagctgacctggattgtcttggatcaaagca

SEQ ID NO: 1235 - DNA, 94 bp, Homo sapiens
ccctgctgacgtctcgccacaacgtcttccagaatgacgagtttgatgtgttcagcagggactcagtagacctgagccgggtgcacaagggcaa

SEQ ID NO: 1236 - DNA, 354 bp, Homo sapiens
ttagcaagtcgaggtaaaacacatgcaacattttctggcaaaagcttaatgtcaaacaatatgtgatccatactgtgtgtcgtccttgggggtttatttgactttgtcacaatgacagccaacagtgagactgataagcctgtaaaaataaaaaaataagactaatcaaatagacatggcattttaatctcaaagtgcaaaatcatctaactgaaaatgacggcattgaaaaattccagtggttaaaaatgaatcaaaacttcattacgcaggcagtggaagtgtgttgaaagatttaccaggggtgtcaagttttagacactcagaaaggcaccattctagccatcttgattg

SEQ ID NO: 1237 - DNA, 35 bp, Homo sapiens
ctgcggaagagtggagtctaaactttttcattgcc

SEQ ID NO: 1238 - DNA, 1645 bp, Homo sapiens
aggtggggcctgtctattatataaaacccttaatttctttaatttccactagtttatcatttttttccagaacagtattattcacttggtatttcaaacacatgttaagaaggaaattacaggtttcctccacccacatttgggctgtcactgatatgcccaagggcagtcctggcagcaccacgcggctgttactgtcattgtaccatactgtattcagcactcactagaaacagggtataggtgatagtatcaacagcaatagcactacaggtaaatgataaacaaaacaaaacagaaacaaaaccaatcccacaatctccaagttcacctggactgtaacttctcttgcaactctttcaaaataaaggacaacagcaacaacaaacagacctctagggtgtttaaaaagatgaagtggcgctgcagagctgggctctgctcaaagatggcagtgccatcttgtacacaccaccatccattataaccgccttccatcactggaattgtatcttatgtaaccaactagcatgcagcattgtaatcttacaactgatcacgtggacagtgaacagcggtcaactttgtcttaaaaaaaaaaaaacaaaaaaccccaaaagaccacacaatcctgaaaatttcccagcagcactctcagtcatcagtatctcaggaactgaacttttgagcaaaatagagattcaaaatccactttcctactcctctgaggacaatgtttcagggtaaactggtggtatttcccagtggcatgcccacttgacaacatgcccgttcgatcatttcctttccttctccaccacttggcctccggcctgagaaaggggccagcaataaggaatgacagacagtaaggcaatcttacaatgtcagaaaatgtatttggctttttttttctttttaaaataagtgcatacaaatacagctagaagcatttctgatttgccaagtgctctaaaaaagcagcgcaagtcacagcctacatagaacggtaactgtcaccaggataataaagcacaaagatatgctaataacgttaacaaaagaaaaaaatgtctttataagtacataccttttgtcgtcaaaaaaaatatagaaacacaatgtattcaaaaaaaatcaaaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccagagaggagtccgggaggctggcagggtgcactggctccagtcctcctgtgttgcctgctccctggccccccacctctctggggcccagccttctttggttcata

SEQ ID NO: 1239 - DNA, 82 bp, Homo sapiens
ggtggaaacacacttctgcccctatactctagtggcagagtggaggaggttgcagggcacggaatccctggttggagtttca

SEQ ID NO: 1240 - DNA, 284 bp, Homo sapiens
cctcccaagaggatggcctgttagaatggactctgagcaccttctcttctatgtgggccctctcttcatcacagggccttccagacatgatacctgttatcagtgccccatcttattcctgagaatggaataactcagctgccaagactccaagctcctccaacttgtttttaaagctgaaagagggtgactccattccccgctggttcgcctacccattcccagccgaccgcaggggagtttggccaccatgtgcacgtgcgtactgtgtctgcctgcagtta

SEQ ID NO: 1241 - DNA, 123 bp, Homo sapiens
atcttggatacaggtggccagactaaatggtctctcaacttgtcttcaagtttaggattttaatttttgatatttttcacttctctctggaaatttgttcaattctcaattgttgggggagtg

SEQ ID NO: 1242 - DNA, 153 bp, Homo sapiens
ccaggcaatcattctattaaggatgtgctagatgacccacagactcaggcctgactcctcaggagctcacagttagtaggggttcagacaagaacacaggtacataactaaaactctattgataagggcgcctcggtaaggtgctatgggaac

SEQ ID NO: 1243 - DNA, 46 bp, Homo sapiens
aggaaggcagactctggtgaagacgtgggccgtcaccgtcagcctt

SEQ ID NO: 1244 - DNA, 119 bp, Homo sapiens
actgatcggcaagaaaatgggtatagaaaaactggacatcttaacagaattaaaatatagaaatttaaagcatattcttgctatggttttagagtccttgaccgcagagagcctatgca

SEQ ID NO: 1245 - DNA, 36 bp, Homo sapiens
gagagcatggcctgccaacttaaacccaaatcaatt

SEQ ID NO: 1246 - DNA, 333 bp, Homo sapiens
gactcgtgtcccaggtttcagaacccgaaaatctcactcctgatcaaaggttgctgctgctgctgctgctgctgctactgctatatgtgtgtgtgtatgtgcgtgcgcgggtgcacacgcatgtgtgcgtgtgtgtgtgtgtgcgtgtgtgtggtgctgaagaagtggaggttgcttggccttctctactgggtgtggccctgatgaactcactgagtgctgaggctggctacaatgtcctatcagaggggaagtaataccacaggagcacatcaagactacaaacataaagaaccatggacactgatttcatccaagttctacagggagtga

SEQ ID NO: 1247 - DNA, 80 bp, Homo sapiens
cctggggctttccagagtccggctgtgagcgcccagcttgctgctggcgtggcgctggggaagcggggctatgtggggag

SEQ ID NO: 1248 - DNA, 101 bp, Homo sapiens
ttcttccctctcctaactccgtcagactggccccaagactgtggcttcaagggccaccagtcccttactcttcaagccctgactatggagttggcagatga

SEQ ID NO: 1249 - DNA, 55 bp, Homo sapiens
tgggctggctgcagaccgccctctctcagctccctggtcaatgcacttcaaattc

SEQ ID NO: 1250 - DNA, 125 bp, Homo sapiens
ccctacccaacatggacagggaggccaaggaggagtaccacgtggtgatccaggccaaggacatgggtggacatatgggcggactctcagggacaaccaaagtgacgatcacactgaccgatgtc

SEQ ID NO: 1251 - DNA, 200 bp, Homo sapiens
tgcacctgtttagtttgtgacaatctgagcccagtacatggttctctgattcctaagccaggagtctctctgtaaccaaactgctattatgtgagcatagaacagctctcaaagtaaatgtcccacttctatttctggcaggttatgtttagctacctttccaaaagagtcccaatcctagtatgcctttcaacagtgtc

SEQ ID NO: 1252 - DNA, 209 bp, Homo sapiens
tggtcacggctgaacaatttcaagaagcgagtcgatgtctcatctccctatcttatcttgaaaaacccgtgtacctaagtcgtggatgtgtctgctgcatccgctgcatcagttcacttctgaaggaaccccatgaggaaggtgtaatgtgctcctttcgctctgtggctactcagaagaatgacatcaggcccgatttccagctggga

SEQ ID NO: 1253 - DNA, 29 bp, Homo sapiens
agtgagctcatcaaaagcacggacaggaa

SEQ ID NO: 1254 - DNA, 1278 bp, Homo sapiens
ggacgaggctgattccgattatctggaggagctggaagacgacgacgacgccagttactgcacagaaagcagcttcaggagccatagtacctacagcagcactccaggtacccacccagcccagttgctgcagactccttccccacctcctctgccctccccccttgctcactcgtgtgctgtgcatcctgctccgatctccccccaaccccgcctcccccccaaacagaggggaaatgcgagggcacatcaagtggcaaaaaactagatttacaagaggaaagaggcgcattgttaaaaatggagattgcattgttgcagtttgcaggctacactcgctcgctctctctctcccccccaacctcctctttttcctcttcaaaatttgtgccagtgcagtgtctccaccgggcaggattgaaactttggcaaacacgtatccattgcattcatttctttccccttgttttggtctggttttctggaatgaaagaagcctcttgttttacaaacctctttgcatttctaatgtggtttctttcagatttttattagatatgttacttaaaagggaattaagggtttggacagattgtggcacacaaacacacacaaaaacatgtctgttttcacatccctagctgtggttttaaaattgtgttaaggaaatggatcatttgggttagtaggggaattttatctggtcctgtatgtttgcttttattcttcgagtgctaatgggcctgtgcaacagttgctggtaaatggctgattaaaaagcaaagcagaaagccaaacaagacccacccaactttggttattcattcgattcaaaattgtttttggttaaatcaaaaatgaaagtacaaaaccgcaggaacgcgcatcttagctcatttgatcgctttgccttgcttgggaaatgcagtttcgtgtcacctgttgcagaagatatgtagttgatcatctagacataattgctgaagataaacttttggaccaacttctaagtcacacagcatcattatcagatttattacacaacgacttttttgttttcactctatttctgaggaaaaagccttcccgaaatccgtaatgaatttctccatggtaacccctcttctgttttcacacagaaaagtttctctagactgttgctaagatgcattttgttaaataccccccccccacaaaggctgctttgtattaaatacgtagttggaatttactaaattgtgaaattaacgtaaccgaagcaacaaccggcaagacttt

SEQ ID NO: 1255 - DNA, 55 bp, Homo sapiens
ctgagaaagccttgagcgttcggagaaagtcatctggaagtcaacatatgatatg

SEQ ID NO: 1256 - DNA, 535 bp, Homo sapiens
tgttatgacccatgaccctcggagcccaaacagcaccatgaagagcatcattaaaactaagagaaagtggctatcagaaaatgaaacagctttaaaggggttccttttaagtcttgttttctattcagaatgttctgtgttttttctcaagtgtgggaatgacatttatcttagcaggttactcaactacactggatgatgtcactctaaccagtgtacggcactgacccaagtcctggggggctccttggaccaatggactattttacaaacctgggaggtgggagggatggtatatttttgataatcagacattccaatgtaatgttttccttagaggtcacacccttccccccattaatgtcatcgtgagatacatcaagtgtgttcttttctattttcgtataataaatgggctttgcttatcaacatcacaatggcaaagaagaaatatactgtacaaaactgcaggaagataaaacatgaaaactttctatgaaaaaaaaaaaacacccttgagtttcctgtcgtcttc

SEQ ID NO: 1257 - DNA, 131 bp, Homo sapiens
cacagtcaatggatccacaaggcctgaggagcagtgtggggggacagacaggaggtggatttggagaccgaagactgggatgcctgtcttgagtagacttggacccaaaaaatcatctcaccttgagccca

SEQ ID NO: 1258 - DNA, 202 bp, Homo sapiens
gtgcctgtatcatgtagacaaaatccaaagcagcttgtttcagacaaaacattttgctttggaaacttttgaaacttccatggccgttgaatatagcagagatgatctaaaaattttagaagcggttgaggtacccgtggtaggggcaaggcatgggagtggtgatccttaaggggcttgtctttagtttgagggccacaca

SEQ ID NO: 1259 - DNA, 597 bp, Homo sapiens
ctaggtcaactgtgtctaagaactactaggcagaaataccgaaaaaaatcaacatagctctggtcttcaaatggcttttttaaagtgaaaattaacttagcatattaagacaaagacaatagaaataatatacataattttattacaaaattttttttaaaaaaacgaaatgcaacatcctaaaaaacccaaaatttactattgatactaattcctacaagtttgctgtgctaccatacacaagaaattaaaaaaaccattaaatatttaggaacattcaacatcagaagctgtaaaatctaactgtatgagtagcccatcaaaaagctacaacctgcattttttaaaagtattttctctacagagaatcttatcagctatacaaaaatctgtacagtttttatactgaagctagtattgagctgcacttgaattcacattcttagcaaaataattgcctgagcacacacacacattccacacgcatcattaaaggatagccatttattcttcatcttcatcctcttcctcctcatcttcatcttcttcttcctcctcctcctcctcatcttctggttcgttcttcttctttgagcc

SEQ ID NO: 1260 - DNA, 109 bp, Homo sapiens
cagctgggacgcggagcacttccacgtctacgccccggagcacaaggtgctacagttcccatgccgtcagaggccgctgggcgccaccaccagggtgcgcgtgctgagt

SEQ ID NO: 1261 - DNA, 1254 bp, Homo sapiens
agcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgcttttaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctcccacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgtcctcttcccatgctacaggtgagaccaga

SEQ ID NO: 1262 - DNA, 59 bp, Homo sapiens
tgcagtcactgcaacaatgacaataccaacatacctggcctagggaatgctggctccct

SEQ ID NO: 1263 - DNA, 462 bp, Homo sapiens
gagatttccgtatccggcctctgtgccaggtctccagtcagaggcgccccttcacgtgggaaggttctggtttcccgactcctagacgcgttggtggcgcgattacccgcgcagcgcgaccgctaccacccggagcgtgcccatcccccaagaaaaatgacaagggccctcgggcctcttccaccccatcctgcctgcattctctctctctctctaattaaaaaaacaacgtaatatcctgtagtacaggctgaaaaaacacgtcaggaaaccactctttaaaaagttcttccatttccttagggaaggtgagagcaggcaggaggtgcgtggagaccctctccagacacgctgccccagacctgcagccttcaggcctctgttgctgacctggctgttaggaatgactgctttttgccgttttcttttcgttacctttctgggttgtctaacgtcttctcc

SEQ ID NO: 1264 - DNA, 30 bp, Homo sapiens
agtctgtctgggtcaagtcaatggaaagag

SEQ ID NO: 1265 - DNA, 64 bp, Homo sapiens
atgccatgccaaggaccaacttccacagctctgtggccttcatgttccgaaagttcaagatcct

SEQ ID NO: 1266 - DNA, 140 bp, Homo sapiens
tgattaacattagagatggttctggaagggtgagtaatatgccaataattagaataaggcaatggagggatggaggaattgatcattcagagaaagatattcccaatggagagatacacgaaggcaaaggtaagaataag

SEQ ID NO: 1267 - DNA, 31 bp, Homo sapiens
gggtcagcagcgtttccctcggcgcttctcc

SEQ ID NO: 1268 - DNA, 45 bp, Homo sapiens
gtagagttcagtgtaggattgtagctttggatctgcgaagtcatg

SEQ ID NO: 1269 - DNA, 50 bp, Homo sapiens
gaaatgtaacatgggcaactccgagcccatgacatgttacaaggacaaat

SEQ ID NO: 1270 - DNA, 53 bp, Homo sapiens
agcttctgataattggaggtgttgcagcccgggatcagctctctgttttggaa

SEQ ID NO: 1271 - DNA, 1363 bp, Homo sapiens
ctggcttagtgaaaggggcctcatccctgacccccaccagcttatgaaggcttcatctcagggaactctggaccccccatttctccctccgtccatctcccctttatcacgtttctttctttcttctctgtgtccccctctttcagagtctcccgtcccccactgccagtctccctgccccctagtcgctgtctcgctcctccgccgctgtctcctgtccagcctgcctgggctgtggcccagccgctctgcctggctggcctccctggctccccctctgcggctctgagctagccccacccccggcccccctccatccagcctctgatccatctgtggactccgaggtcgggtgcccgtcacacggcccctgggaccaaggacagactacagcccctcagcacccacagaggcttcccctcagccctagccgaggagcccccagcggagggcatgggggtgggccgccccaacaggtacgtgcctccatgcaaggcaccgctgagccatcccctcctgctctgctgcgtcgcccccatccacccctgccccagcatccctgtcctcagcttgtccccttcaagaaggccttgtcttcccatcagtgacaggctcagcgccaggagaatccacccccaggttcagtgcctccaactctcaccccatccccattttatgcattttctcactggcttccatcctttcagagaaaccctctcagtctgtctgtctctgtctctgtctctctcccccatctctgtctctcccatctctctctgcctctctctgtcttcacaatttcatctccccatgtcgccatttcttaaaacatttcttttctccttttcgttttcccaattgccctgtccgcctctatcttctctgtccccctccatctaggtctctgtccccccctctctctgggtctctgtccccctctgtctctgagtctctatcctctcaaggtctctgttcccctctctctgggtctctgtcctctctcaaggtctctgtccctttctctctggatcaatgtccctttcctgctgccctctctgggtctctgtccccctctctctcagggtccctgtcctgcttggtccctgtactttttcttggggcaccctctcaacacccctcctcctgcctatctctgcatctctttgtctttctgtagtctctgctttccaacctgctgtccagcccccaccagtaggtggggagtggtggggaacacccctggtttcggaagagtgagagtgttgatttgggagggtgagggtggggcctgggggcggggcttcttggcctcagattagacagtgactttgacacgaagttgaagcaccttaagccctgtatc

SEQ ID NO: 1272 - DNA, 132 bp, Homo sapiens
ggaagccaagagatgagtttcaaggatgggaggttgacagagccttttgcagagaagttaaaagaatggagaaaaggccattgattttgaaaatagggtaccatgtagtgagttgagagaatagctttgaca

SEQ ID NO: 1273 - DNA, 302 bp, Homo sapiens
acatttcttctcacaggtctctgtccctcaatacaagtaattaacccaaatagatgtctgcaaacctctgctaactttttagcagacacaggaacttctcaattttattgtaattactacagactatggtaaaagtaacggcaaagtttacttactagggtctggggggcatacatggaaaaagcacttaattcaagctcagggaagtgagcatggggagctggaaggattcctgaaagacaatacaacaaaactgagaacctaagaaaaagtggcaattagctaggctacatggaccctta

SEQ ID NO: 1274 - DNA, 28 bp, Homo sapiens
agggaaccctccatccaggtggtcaggg

SEQ ID NO: 1275 - DNA, 1038 bp, Homo sapiens
ctgtctcgtggttgagctcgcaaacctgaaaactactgacgcgccttccgactctcacggccttttctcttgcttgcctgcggtgccaggagagggtttggaatgaggaaaggggttcccacgcatttctgctgtttgttctgtgaatggaaacactgtgccaagccccaagaggattacgcttccaggtgtgtaacgtgttttctgtgtctgccgcttccagcagctgatatctttggaacaaataatccacgtcagcatggggaccaattaggatgcaatgacaaactgacttcccccaaagcagacactactccagtatgtcccagtagaacactcatttgcaatgtgttgagctccgttaagcacacacacactcacacaacaggcttacgaggctcaggcctggcgggtcagaaagcccactccctctcccaaggccactggatcccaggagaagcccagactggcgatactacaaaggtctccagggcctggcagaccccagagtcaggcctgctgttaaaaagtgagagtgctgctgttccattcctggggtcccaagcacttccctttaccccaggacccagggcagcctgcagggcagctggcggtggccttggccatttgcccccagcctccagctggctcctgagctctgcaccagggggtttggggaccacacaggcacctgccttcctagatttccctggctcacttttctgcaaacactggatctgccaggcctggggattggggggcaggaaagaggcccccatccagccccctccaggccagtgtgcacagtgcaccgaggggtcatccgcacagagcgaggtgcaagctcgatgtgtaacctggctgcggcacccgacatccccggtctcggggtgttgatttatttctgaataactttttgggtatagaaaccaattttttttaatatatgacatgtatatgtacacactcatgtgaaatatgtatactttggggggatctatttatgttccagtgggagtcactctcttctgtcgggaa

SEQ ID NO: 1276 - DNA, 279 bp, Homo sapiens
cagcagtgattcttagggcagcatgtgcaaaatccagtattttgctatctacttacatcactgtagtcagaaaagaaatgtgccaaaactacctttcccattccacttgaactggttccccacaatcccaacaaacatctcctgtgacattaagttgtcatcagcttgcgtgatccccagttcactcaaccttttcttctttatctggcctttctgtgtggaggcagcaattagttcatttacaatttcacaatttccctcgacttgctcagaagggtc

SEQ ID NO: 1277 - DNA, 63 bp, Homo sapiens
agagacagcctggaaagattgggtgccagctgcagagaggagagcaaggcgaccaaacgcagg

SEQ ID NO: 1278 - DNA, 36 bp, Homo sapiens
tgaatcatggtgctcctactaaattccaggtgtccc

SEQ ID NO: 1279 - DNA, 50 bp, Homo sapiens
atgcataaagtagtgaacaggcccggtgctgatgacaggacggactctgt

SEQ ID NO: 1280 - DNA, 39 bp, Homo sapiens
gattgggtctgtacagtgtatggtaactgctcactgttt

SEQ ID NO: 1281 - DNA, 225 bp, Homo sapiens
tctcgacagtattctgatgcttgcaaaaagaaatactatcataccacgttgttctgtgacagaaagcttctaagataagtttttggaattaagaagtacacattattgcatgagggtcataataatagccagcatttatttgggcactttccacgagccaaacaccatctaagtcctttacatgcatcctctcctgagaattgtcttatggaggcagcgttatta

SEQ ID NO: 1282 - DNA, 28 bp, Homo sapiens
gttgaccgcccttcgagcccggtgctga

SEQ ID NO: 1283 - DNA, 65 bp, Homo sapiens
caagcccgaactggaatcttccttcacacatctggaccaaggtgaaagactgaacctgtcctgct

SEQ ID NO: 1284 - DNA, 45 bp, Homo sapiens
tgcaaggcctcagagtctcggcacgcgcgggaacccactggctgc

SEQ ID NO: 1285 - DNA, 114 bp, Homo sapiens
gtgtcattcgtactcctcagggaaatgccctcctggtcggggtgggcggatcaggaaagcagagcctgacgaggttggcttcattcattgctggctacgtttccttccagatca

SEQ ID NO: 1286 - DNA, 387 bp, Homo sapiens
tgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggattta

SEQ ID NO: 1287 - DNA, 28 bp, Homo sapiens
cgccgcccgcgggcctgtccgacgccgg

SEQ ID NO: 1288 - DNA, 89 bp, Homo sapiens
atggtctccgagtggatctcccagctgagaagttagcatctgtgtccgtgagtcgtacacctgatggctccctgctagtccgccagaag

SEQ ID NO: 1289 - DNA, 52 bp, Homo sapiens
attccttcctccagtgtgaccatcacacattgtccatatggctggatgtgag

SEQ ID NO: 1290 - DNA, 371 bp, Homo sapiens
ctgcctactgtgtcgtcttttcttatgttgaagttgacagacctgctctattctcatactaatagactatttttagatttttttaaagtaatcacaataaattcagtatatcttaagtcttttggcttcctgtgaacttcttcccttgacagtttatcttagcactgaaacatcaaatatattgtatctgctttatctaatactcagaaacaaagaacctacgtgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggta

SEQ ID NO: 1291 - DNA, 141 bp, Homo sapiens
tgacagaaatagtaggttcgaaacaaaggaggattgtgggaatcgtgattcaaatgttctttacccttggaatcataattctccctggaattgcctacttcatccccaactggcaaggaatccagttagccatcacgctgc

SEQ ID NO: 1292 - DNA, 105 bp, Homo sapiens
gcgtcctcagctggccgagcatggtggcagcctgcacccttggctcccttgtctggtgcagccagcagagccgccagccttgggcgcccatggccctccgtgtga

SEQ ID NO: 1293 - DNA, 42 bp, Homo sapiens
aacaacattaacttgtggcctctttctacacctggaaattta

SEQ ID NO: 1294 - DNA, 473 bp, Homo sapiens
gtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccga

SEQ ID NO: 1295 - DNA, 114 bp, Homo sapiens
tctccaggcccgagagaccagcaaaccgtcgccctccgtcccgttgggccccacattcccccactgcctcacagcctcagtcacccggagacccgacgtccttggaggagcatg

SEQ ID NO: 1296 - DNA, 51 bp, Homo sapiens
cacctgggctcctatgaatgcaaactctgcctgacacttcacaacaatgag

SEQ ID NO: 1297 - DNA, 522 bp, Homo sapiens
ggatccttagactcaccaataactgaagctacagtgattacaaacctgatagaacctcacaatttgaacagaaaaggaggagacaaaattgcagcgtgtgtttggggcagaggtcaggaaggctgagatgtagaccacatctgcatcttttgggccagcagcctttggaatgatcagggaacagtgagcgtaggagcttgtcttatagctgctgcgcctatcccaacctttgcccccagttatctcatttagaaaaccctctggctccaggggtccttctactgcctccatgtaatagatgtctgcatgagtcaggggtagaaactccacccctccaggggtgaggttcttaatccacaatgagctgcaggtgtttccaaggacaaactttagtctcagatcacattcatatcagaggtcctaggtcacccagttcactttccaggatcatatacattctttcattagggtcacaagagatacagtaacttctgcatggtcttctgatccatgcccattgtg

SEQ ID NO: 1298 - DNA, 283 bp, Homo sapiens
cagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgc

SEQ ID NO: 1299 - DNA, 312 bp, Homo sapiens
gtggtacggaccctttccatgatccccaaaagtttccttgtgtctcagtgaagtcagtcccctccccccactctgggctctggaaacccagatctgctttctgtcatgacagttttgctttttctagaatttcatagaaacagaatcaacagtgtctcacttggcgtcccgttttgtcataccttttatgctgtctaaatgggggatgctggttttgatttgaagcaaagggagaaaagggtgatgttccgggtaacactatctgttcagaggcttgttgcctagtatcgacactctctattcatgggaaaa

SEQ ID NO: 1300 - DNA, 53 bp, Homo sapiens
cagagacacccaagacgagctcggaggcctcccacgactctgcctctggtgtg

SEQ ID NO: 1301 - DNA, 151 bp, Homo sapiens
aggtctcaatcaaccaccatatgtgtgagtgaaggaaccttcagataattttgcttcccagacttcaagtctttcagctggggtccaagacatcacaaggcagagacaagccctcctggaattccccacccaccgtgagcataagaaaact

SEQ ID NO: 1302 - DNA, 408 bp, Homo sapiens
tctccatcaatcatagcccggtgtgtttaacttagagtagatggtggcaccacccgataacaatggtggtggcattcagcagcagctcagagggttccagaagcattcctccagcctcgaggggaaatggtgcctctggctaacggagggaaccatcaaagccgggtatggtttctttgatcgtgtttagccgctttgtggctgagtagagattcttccttcttcctgtccaggtaattaatgagggacttcaaaggcatgaggcttttctgctccaatcaattattcagattggcatatccaaaggtctctgaacaggaaatagagaggaaatggattgctaagtggttatgatggagactaaatgaattacttgttaatcacccttgtctgctctggtagtatctg

SEQ ID NO: 1303 - DNA, 42 bp, Homo sapiens
accaaacagatgaacgaacggagcacagcagtgctatgaaag

SEQ ID NO: 1304 - DNA, 72 bp, Homo sapiens
accgggaaggcatcgaatttgctgcgatgtctgtgcagctcacatctgtgatcggtggaccaaagaaccagt

SEQ ID NO: 1305 - DNA, 102 bp, Homo sapiens
tgcccaagttcaaacaacgaagacgaaagctaaaagccaaagccgaaagattattcaaaaaaaaagaagcctctcactttcagtccaagctaattacacctc

SEQ ID NO: 1306 - DNA, 137 bp, Homo sapiens
aggcacgcatgcaaggcctgcctgccgtgcctccctctgccaaaggcatttttagcaatttcctaaaaatgtggctacaatggaaaatgaagctgttcagggggagaagtgatggccccgaaatgcatccaacagcc

SEQ ID NO: 1307 - DNA, 72 bp, Homo sapiens
gtttgaggtggatatgaaaattgctgcaatgcatgtaaaaagaaagcaactccatcaactactacctaatca

SEQ ID NO: 1308 - DNA, 69 bp, Homo sapiens
ggaggtacaagaaagatccacaaaccagagaaagctttccagcagtcagttgaacaagacaacttattt

SEQ ID NO: 1309 - DNA, 36 bp, Homo sapiens
tgaagttagctgttccctcagtagctctttgttccc

SEQ ID NO: 1310 - DNA, 144 bp, Homo sapiens
gtgatgagtgttgcgggcatcagcaggtgcacagctggtggagcacagcctgaagaatctgtgcctgcactcacagcccagtcccaggacagcgggctttgctgccccattgcccattacttagccaagtcgatctccatgaaa

SEQ ID NO: 1311 - DNA, 210 bp, Homo sapiens
tggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaa

SEQ ID NO: 1312 - DNA, 86 bp, Homo sapiens
gaaagaggactgtggcggctctgctggagaggtgcataccatttgggatggtgacaaggagttggagaacgcgtgtggaaattgac

SEQ ID NO: 1313 - DNA, 60 bp, Homo sapiens
ccagcgagtgatccaggtggagaattcccacatcatcctcacaggagcaagtgctctcaa

SEQ ID NO: 1314 - DNA, 28 bp, Homo sapiens
aaactacaaaaagctctgttgaccacca

SEQ ID NO: 1315 - DNA, 46 bp, Homo sapiens
tgtcagtgtgtcagggcacctgtgcgggcacggacagggctctgca

SEQ ID NO: 1316 - DNA, 408 bp, Homo sapiens
tgaccttacctaggatatagcctggcatcatgtaacataagaaagttgttttcattttggtacaagcaaaatgaaatatgtttagcctcataaaaaatcatctacaatattgagacttgagagtatggcaaactctggtaaagttaataaattaatgtgctgcctagggtttgtttatatctggaaaacaggaaacggtaggtaggtaggtaggtaggtacataggtagatagatatagatagatagatagatagatagatagatagatagatagatagatataatacaatacttttcttagagtcagagcctggacatgacaacactaacaatagggatattctgaactgctccaaggatccaaatccacctggaccctcaacctaagagagggaatgccaacattc

SEQ ID NO: 1317 - DNA, 746 bp, Homo sapiens
gtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgtta

SEQ ID NO: 1318 - DNA, 70 bp, Homo sapiens
gtgccaataccatgaagaggagctcagacagctcttaccacatgatacaagagccggctggtggaagagt

SEQ ID NO: 1319 - DNA, 109 bp, Homo sapiens
aggtgaaggaagacagtgcgtacgggagccagtcagtggagcaggaggcagagaagctgggcccaccccctgagccaccaggagggctctgccacgggcacccccagcc

SEQ ID NO: 1320 - DNA, 89 bp, Homo sapiens
gtacataggctatgcaaaaggaacgagatatgcagaggcagagcccagagtagatgccagaaaggcagtggaagcagagactcgtggca

SEQ ID NO: 1321 - DNA, 71 bp, Homo sapiens
gtactgccatattccacatgcccgttccctcacgtggtgtgtaggtcctggggatgttaaacacttatgga

SEQ ID NO: 1322 - DNA, 79 bp, Homo sapiens
ggaactggagggctttttcagggcaaaactcctttgagaaaggctaatcttcagcaagctattgtcacacctttgaaac

SEQ ID NO: 1323 - DNA, 45 bp, Homo sapiens
tttaggaaaaggctgctatactgtggacgaagtctcagatcagaa

SEQ ID NO: 1324 - DNA, 104 bp, Homo sapiens
ttgtgtgggcgttataggacagaccgtggggtggggcgggggatgggggaggtggacaaatgaggtctggatgagaagtgtgaccaggcgtgtttgactcatgc

SEQ ID NO: 1325 - DNA, 79 bp, Homo sapiens
tcgtctaaggtttccaaaagaagcatcagccccagtcagagaaaccccaatgtcccagtccctcgtaggaaggcagtgt

SEQ ID NO: 1326 - DNA, 28 bp, Homo sapiens
gtaagggatgtctctgcgccatcctcag

SEQ ID NO: 1327 - DNA, 60 bp, Homo sapiens
tgctggcccaaagccagtccagcactgcctcctctgactctaaaatcagaagagtcctga

SEQ ID NO: 1328 - DNA, 120 bp, Homo sapiens
atgacctccggcttcctgcggggctccatgtggtctggacagacacggaagcacagcagcgtgagcgccaggaccaccttcatctcagccattgcaaacgcctgcccaatgcagttcctg

SEQ ID NO: 1329 - DNA, 677 bp, Homo sapiens
cagcgtcttagtctgtcgccaaggctggagtgcagtggcgcaatcaaagcttgctgcagccttgaactcctgggctcaagcaatcctcttacctcagcaactaggactacaggcacatgccaccacgcttggccttctaatttatttctgtgtcaacaaaataaaactcaggcctaggaatagcttggttcagaaatcacagagggacttagtattccattaatacaaatggaaacattaagttcatcatcagatgataaaaggaaaaaaaaaaacctgatactcatctcaaaagacgcagaaaagacatttgcataaatccagtacctattattatttcaaatttaaaaacttcttcttttttaagagatagggtatcactatgttgcccaggctgatcttgaactcttggcctcagatgatcctcctgcctcagcctcccacagtgctgggactacaggcatgagccaccacacccatcataaattaaaacttctgaacaatctagtaacaaatggaaatgctttcccatgatccagcacatctagcagggggtgtctgctgacattctacacaaagagacacactggagttgtgcttctcatcatttcacattaagaacccaactgcacctttttctgtgcctctaaacacctgtagtctgataggggacaccc

SEQ ID NO: 1330 - DNA, 115 bp, Homo sapiens
ctttgccgccggcttgggcacgtttcctcagcgtctctggctccccgtattcttgtcttcaacacaatgggtggaagtgtggttcagtgtctaagaaagtctccagcacagtgtg

SEQ ID NO: 1331 - DNA, 179 bp, Homo sapiens
gttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcaca

SEQ ID NO: 1332 - DNA, 161 bp, Homo sapiens
tgactattgtagctccaagaacctcacccccaaagccaaacaactattttacaagctgcggtggacccgcttacaaaatcagcttaagaaacgtaaccttaaattttagaattacagattttaatgacttcatattccacgactgaccctctgagtttttt

SEQ ID NO: 1333 - DNA, 160 bp, Homo sapiens
ttcctatgatattgactgcagtttggaaatcaagaaggaggtggtccaatgcatgggctccttccaggatggggtggctgagaagtgtgttgattattttcagagattccgacgttctacccacgtgacgcccaaatcatacctctcctttattcagggc

SEQ ID NO: 1334 - DNA, 1546 bp, Homo sapiens
ggtccacagacggtagtttccaagaccgtttcagggaattcgaggattccaccttaaaacctaacagaaaaaaacccactgaaaatattatcatagacctggacaaagaggacaaggatttaatattgacaattacagagagtaccatccttgaaattctacctgagctgacatcggataaaaatactatcatagatattgatcatactaaacctgtgtatgaagacattcttggaatgcaaacagatatagatacagaggtaccatcagaaccacatgacagtaatgatgaaagtaatgatgacagcactcaagttcaagagatctatgaggcagctgtcaacctttctttaactgaggaaacatttgagggctctgctgatgttctggctagctacactcaggcaacacatgatgaatcaatgacttatgaagatagaagccaactagatcacatgggctttcacttcacaactgggatccctgctcctagcacagaaacagaattagacgttttacttcccacggcaacatccctgccaattcctcgtaagtctgccacagttattccagagattgaaggaataaaagctgaagcaaaagccctggatgacatgtttgaatcaagcactttgtctgatggtcaagctattgcagaccaaagtgaaataataccaacattgggccaatttgaaaggactcaggaggagtatgaagacaaaaaacatgctggtccttcttttcagccagaattctcttcaggagctgaggaggcattagtagaccatactccctatctaagtattgctactacccaccttatggatcagagtgtaacagaggtgcctgatgtgatggaaggatccaatcccccatattacactgatacaacattagcagtttcaacatttgcgaagttgtcttctcagacaccatcatctcccctcactatctactcaggcagtgaagcctctggacacacagagatcccccagcccagtgctctgccaggaatagacgtcggctcatctgtaatgtccccacaggattcttttaaggaaattcatgtaaatattgaagcgactttcaaaccatcaagtgaggaataccttcacataactgagcctccctctttatctcctgacacaaaattagaaccttcagaagatgatggtaaacctgagttattagaagaaatggaagcttctcccacagaacttattgctgtggaaggaactgagattctccaagatttccaaaacaaaaccgatggtcaagtttctggagaagcaatcaagatgtttcccaccattaaaacacctgaggctggaactgttattacaactgccgatgaaattgaattagaaggtgctacacagtggccacactctacttctgcttctgccacctatggggtcgaggcaggtgtggtgccttggctaagtccacagacttctgagaggcccacgctttcttcttctccagaaataaaccctgaaactcaagcagctttaatcagagggcaggattccacgatagcagcatc

SEQ ID NO: 1335 - DNA, 238 bp, Homo sapiens
ctgatatggcaaggaatgctgtctcaagagaagatgccagcgggtggccgctgtcctggcctgtggctcttccctgctcccttcaccctctcaggaccagtcacaggatgggggccagcctcccgctccctatatgcccatcagtccccgaggtgcggggtgggaacttggagagcaccgtgctgcatggaacgctcttgtcaccagcaaatgcctcagtggctatgtgggaacacaa

SEQ ID NO: 1336 - DNA, 31 bp, Homo sapiens
aggccaagagcggatgttcttcatttcactt

SEQ ID NO: 1337 - DNA, 89 bp, Homo sapiens
ctgagagtgccattgtaactgctttcattaccttcattcccaagttcatcgagtcacagtttggtatcccagcctccaatgccagcatc

SEQ ID NO: 1338 - DNA, 31 bp, Homo sapiens
agaagaataatggaaccactttggaaatagg

SEQ ID NO: 1339 - DNA, 537 bp, Homo sapiens
cacacatggcgctgtcaggatacacaaggacaatagccaaagagttacaaaaaataaatccatgattcttaaacaattgcaaccaaaaaaaaaaaaaagttacaagtatcaaaactttcagatgcattgcattgaaaagaaggtttgtgcacgtcataatttaaagaggcaaaaccaaggagctactgaaacctcacgttaaacagtttattataaagctgatggaaaggagcaagttgtctctctgtatcagcttcccttaacagttttccattaattgaagaaagaggtgggaggggtgaattcatttttgcatgcacaagatgtactgcttaacgaaacactatcagcttgttttaaatggatcttttaaatatcaactgtagcctggttggctaattctttctaatcttccccattactttcgcctagatttcccatagatcaacaggcatagtaaaatgcctcatcagaacacacttctccacacaattcaaaaagggagctcctgtgggctcaaagcaaccatcagtccag

SEQ ID NO: 1340 - DNA, 104 bp, Homo sapiens
ccttcttagtagatcgtgatactccgggccttcatatagggaaacctgaaaacaaattggggctcagagcttcttccacctgcccgttaacattcgaaaatgtc

SEQ ID NO: 1341 - DNA, 124 bp, Homo sapiens
acccttggttggctctccggcattccagctgcagctgctggggctggctgcaggcacgtctgactgttctcccctttggagtagacagggttgttctggctgtcccatgcattgcctttcaata

SEQ ID NO: 1342 - DNA, 331 bp, Homo sapiens
ccagtgcgatctccggccttatagacgtctcgccccgaacatcccgtgctcggggcgtggcagcaccggggcctcaaccgtgcagggtgtggataaacccatcgtaagttgaaaatacctgaagtggaaagtgcgctttcagcttagacgaccgttttatctggacgcagccccatcggacgtcgaggagcctatgaatgcgtatcagcgttatcagaaagccgaaaaaaacttaagttgaaccatcctaagtcggggactgtctgtccacccttgccgacttgacctctttttcccggttctctagagtcagtataccaccagcccgttc

SEQ ID NO: 1343 - DNA, 91 bp, Homo sapiens
gtcccacagatcgttctcaacattgacttggcccccacgatcctggatattgctgggctcgacacacctcctgatgtggacggcaagtctg

SEQ ID NO: 1344 - DNA, 894 bp, Homo sapiens
tgcccgtctgtcagcccttgaaggaagaagatgatgatgaggggccagtggacaagtcttccccaggaagtccccagagtccctctagtggggccgaggctgcagatgaggacagcaatgactcccctgcctccagctcctctaggcctcttaaggtgcggatcaagaccattaaaacatcctgcgggaatatcacaaggactgtaactcaggtcccctcagatcctgatccacctgcccccttggctgagggggccttcttggctgaggctagcctcttgaagctgtcccctgcaacacctacttctgagggtccaaaggtggtgagcgtacagttgggtgatggtacaaggctgaaaggcactgtgctgcctgtggccaccatccagaacgccagtactgccatgctgatggcagccagtgtggctcgcaaggctgtggtgctgcctggggggactgccaccagccctaagatgattgctaagaacgtgctaggcctggtgccccaagccctgcctaaggctgacgggcgggcagggctggggactgggggacagaaggtgaatggtgcctcggtggtgatggtgcaaccttcaaagacagctactgggccaagtacagggggcggcacagtgatatcacggacccagtccagcctggtggaggccttcaacaagatcctcaacagcaagaacctgctccctgcctataggccaaacctgagcccaccagctgaggctgggctggccctgcctcccaccggctaccgctgcctggagtgtggggatgccttctcattggagaagagcctggcacggcactatgaccgtcggagcatgcgcatcgaggtcacctgcaaccactgcgcccgccgcctggtcttcttcaacaagt

SEQ ID NO: 1345 - DNA, 63 bp, Homo sapiens
atggctataagaacacacccaatgccagtctctaccacaccgcagcagcataacttactacag

SEQ ID NO: 1346 - DNA, 80 bp, Homo sapiens
tggcaccatctctgtggtgaagtcacaggtgcaagcccacgtggatgcagacgtgcacatgtgtgtgacgtttcgggttt

SEQ ID NO: 1347 - DNA, 28 bp, Homo sapiens
acccccagtcggcctactgtgcctcagc

SEQ ID NO: 1348 - DNA, 64 bp, Homo sapiens
ggcagaggttctatgcctctgtccctgagaacttctccaggatcttggaaattcctggccttca

SEQ ID NO: 1349 - DNA, 78 bp, Homo sapiens
aacggcgtgctgacctaccatccaaatttacatgattacatgaagaatattcatggtaaagagattgaccttgggaga

SEQ ID NO: 1350 - DNA, 102 bp, Homo sapiens
cccaggacaagttctgtgggcatccttcgaaaatgaaagcaccgttacaacacaccactgatcaaggggaaagtgcctttgtactcaatggcgcaattggta

SEQ ID NO: 1351 - DNA, 54 bp, Homo sapiens
tgccgacccgtaccatcacaccatcgggcccgcggcgacctacagcattggaac

SEQ ID NO: 1352 - DNA, 347 bp, Homo sapiens
tacaaaaggatcagcccatgacagcagctgaacaacacttaacaggacaaaaggaaaataaaaatgccagacaagatatacagtggagggatgcacatacaaagagttgggaaaaaggaaaaataattacatggggaagaggatttgcttctgtctctccaagtgacaatcaggtgcctctgtgggtgcccaccaaacatctgaaggtctatcatgagccacaccaggaagagaggactctgggaagagccagaactccctatacgagtgatggcatgaatgaaaatctcagagacaaaggaaaagaccaagaatactcaccaggcagaccctccaacatggggaca

SEQ ID NO: 1353 - DNA, 129 bp, Homo sapiens
ctgcgcctgtctaccttcgagaagagaaagtcccgcgaatatgagcacgtccgccgcgacctggaccccaacgaggtgtgggagatcgtgggcgagctgggcgacggcgccttcggcaaggtttacaag

SEQ ID NO: 1354 - DNA, 33 bp, Homo sapiens
gcgggccatctgcatgacaaaggcgcgccccgg

SEQ ID NO: 1355 - DNA, 33 bp, Homo sapiens
gagaatttggcttgcgggagtactcagaagtta

SEQ ID NO: 1356 - DNA, 326 bp, Homo sapiens
aggtttcattggacatatacttccatgtggctggggagatctcagaatcatgacagggaggtgaaaggcacttcttacatggtggtggcaagagaaaatgaagaagatgcaaaagcggaaacccctgataaaaccatcagatcttgtgagacttattcactatcacaagaacagtatcatggggaaaccgaccccatgattcaaattatttcccacctggtccctcccacaacacgtaggaattatgggagctacaattcaagatgagatttgggtggggacacagagctaaaccaggggaaaagcacattctggggcctatcaga

SEQ ID NO: 1357 - DNA, 149 bp, Homo sapiens
ctaccccgcaagtcgggcagcctcagtgagaccagtgatgctgatgaggacccagcagatgccctgaaaggaggcctgccagcagcccgcttctcgccggctgtgcccagtgtggacagtgctgtggagtcttgggacagctcggccac

SEQ ID NO: 1358 - DNA, 33 bp, Homo sapiens
ggctgatgccagcccgggcgtgcccctcaacac

SEQ ID NO: 1359 - DNA, 120 bp, Homo sapiens
aattacagtgatgcgccccaccatatcccaattaaatacctctttcataaccagcatccatcaacagaatacagtgcccaataagaaaagcaaaaccaggatatcttctaccttaatata

SEQ ID NO: 1360 - DNA, 64 bp, Homo sapiens
agctacacaggaaataacaccaccaaaaataacacattcaaactcagagggcaatcttccctaa

SEQ ID NO: 1361 - DNA, 112 bp, Homo sapiens
ggcttcgcgccccaatttctaacagcctgcctgtcccccgggaacgttctaacatccttggggagcgccccagctacaagacactgtcctgagaacgctgtcatcacccgta

SEQ ID NO: 1362 - DNA, 50 bp, Homo sapiens
gaacagaatttacactcagccctggtaaccagtctatccgtcagtaccag

SEQ ID NO: 1363 - DNA, 343 bp, Homo sapiens
tagggtcttggggtatcaatgtctcccactccatttcctgctcatcttccaggactgggtctagtttcccattcacacacctctgtggctcctccctggttacctaattcttgactctgtcaatttaaggagcagcagataaggcttagtaacttactattgatgttttggatccatgagcatcagctaaggcctgctggaaagcttcaggcaacgcacagagcacagcagctcaccaggactgaccctcacactgggcccggtggtgtgcactccaccagcactaactcgtcatgtctctcatcaaaaaatttggcatgtccactgtgccaacaaagtcctg

SEQ ID NO: 1364 - DNA, 252 bp, Homo sapiens
tggctccctgttgttcttagcacaatgacccaaatcctcagcatggcctctaaggccctgtactggtgccagctgccttgccagcccacgcctggtaactccgacccttgctgtgcactcatcccccagcatctccagttcccagcactcagactcctgccagctctaggcctctgcacacagtgaccttcagctcagagcacaccccctctcccagttcactcctgtgtgtccctcaggtcggtgtctact

SEQ ID NO: 1365 - DNA, 35 bp, Homo sapiens
atgccatggtccctagacacctcagttcattgtgg

SEQ ID NO: 1366 - DNA, 285 bp, Homo sapiens
acgcttcgttggtctcgggaatacagctccacacgcaaaaaagtaaaaagtgcagcaaaacaacaacacaacgatcaacctcaaaggaaacaacaaaattaattttatcaaaatgcaatgtgtacattaagactaaagttatggattgttcctgtttggcatagaaatgtgatgactattaacagaaaggggaaaaagatttgccccctatccatcatcagacagacagacttctcttactaaaccccttatgtggagtgggatgagtgactatttcctgcagaa

SEQ ID NO: 1367 - DNA, 57 bp, Homo sapiens
cagagccagcttctggacgaaatactgttctcagcaaaagcgccaccaaagaaaaag

SEQ ID NO: 1368 - DNA, 111 bp, Homo sapiens
tttactgaaataagccattcaatcaatgggcaataatccttggatataaatgcccaggctttgccacccactagggtgactctaagccaagtcacttcatctatgaatgcc

SEQ ID NO: 1369 - DNA, 77 bp, Homo sapiens
ttttagctgtaacaattagaaggagaaaagttgacagttattgagatgtagaaggctgtggaagtcaggcacggtgg

SEQ ID NO: 1370 - DNA, 54 bp, Homo sapiens
gagcagaggcttgaggggtatggttgggtagccatggatgcagcgggtacgtac

SEQ ID NO: 1371 - DNA, 81 bp, Homo sapiens
tacctagacctaaacggctcagacaggcagatttgaggtttccccctgtctccttattcggcagccttatgattaaacttc

SEQ ID NO: 1372 - DNA, 109 bp, Homo sapiens
acgtgtgaatgcagcgctgtgtctttaaggggcacgcgcggaggttttccgtccgggacaaaatgtcagcgaggcgcctggagggggatctaccatctcggactcccga

SEQ ID NO: 1373 - DNA, 121 bp, Homo sapiens
ttgctgatcaccttgcggggacagccagccaatcagtctgtcctgctgtccatttatgatgaaaggggtgcccggcagttgggcctggcactggggccagcgctgggtctcctaggtgacc

SEQ ID NO: 1374 - DNA, 375 bp, Homo sapiens
ctacaggtgttagtttctctccagaaaagaaaaagcaaaatacttggatattgaagtgctaattttaaatgtctgtaaaaatttgtgagggaacaaagttattttctattatgaatttactaaacactagatgacattttaagccatcatatgttatcaataaaaattagcacaagagaaattccagcacagggcacaggatatagtaggcaataatataccttagagagagagaagaaggaaaatgagagacagaggaaggctctattttaaaatgacataaatcattttcctgatcttgaagactaatggagatagggagaaaggataaaataagcccatgtaaaattgcctagactctgaacaagcaacaag

SEQ ID NO: 1375 - DNA, 602 bp, Homo sapiens
acgactcctagcatcttcgggaggctcctgaaggactgaagcaaaggaaatctctgaagggatttagtccttgaaagggagtagggatacttagggtgttctgtgttgagcgcttcttcctatctctccagcttcatgtatgtgtgtctttatgtccaagcaattgagccaacaagtcctcagaattccttgtgaaaaaaacgttttttttttttgagacggattctcactctgtcgcccaggctggagtgcaatggtgaaattcagctcactgcaacctccgcctccggggttcaagcgattctcctgcctcagcctcccgagtagctgggattacagtcacgcgccaccacgcccagctaattttgtatttttagtagagacaggatttctccttggtcaggctggtctggaactcccgacttcaggtgatccgcccgcctcggcctcccaaagtggtgggattacaggtgtgagccaccgtgcccagccctgaaatagtcttaattgcttgtttttcttttttgtctgaggtgtgctttttaaaatctctatggagatggagaagactgacattctctggcctgatgtgaaaacctctc

SEQ ID NO: 1376 - DNA, 87 bp, Homo sapiens
aggctttgtctttcacctggagagaaaataggcagcttagctctctctcgactttggggacatctgtctgctggtcgaatccacctc

SEQ ID NO: 1377 - DNA, 65 bp, Homo sapiens
cagatacacaaaattccaccccatgatcaagaatcctgctccactaagaatggtgctaaagtaaa

SEQ ID NO: 1378 - DNA, 86 bp, Homo sapiens
ccacactttgattagcaaggatttagagccaaggggcttccatagcacagacaatattggatccaccaccaaaaggttacaaatca

SEQ ID NO: 1379 - DNA, 39 bp, Homo sapiens
agtttctgtcagcagtagtttcacccatttgcatggaaa

SEQ ID NO: 1380 - DNA, 553 bp, Homo sapiens
caagcccaaattatggactgcagcaatttaatcatcactgccatttttcttacttccaaaataaagccttgattaaaccattcataccctatattactcatacctttacttcagagattgaggaactatatacaacaaattaatttattttcaccatagggataacatactgtacctctctgccaatgttacttgaaaatcttccatgtcaaaacaacttgacagtagatataaacaattcaataaatatgcaatgatctttcattacagtcctttaaagacgcatgttaattcatgctgttaaccttaggatcacagtgcatagaatccaaatataaacagttggggtgacttttaaagtaatgttggatccctcactttatttatattcccactataaccagtaagttcatttcataggccctatcatgcattaatcattgaatggcaggagttaatgaaaacttttcctgttacaacgcccattgccggcaatgaacgtaccaaaaccgccaaggaagtcattgttattgcacaatacatgaggacctgg

SEQ ID NO: 1381 - DNA, 30 bp, Homo sapiens
gaggtgataccagagccttcgcaacaccag

SEQ ID NO: 1382 - DNA, 68 bp, Homo sapiens
tgaggacattgcaagcacctccagaaggtctctctccacctgtgatatcctatgtttctatgaatccc

SEQ ID NO: 1383 - DNA, 71 bp, Homo sapiens
gctgacctattgctgaggactatgagaaaaaagttattacagaatgagtcatatggaaaacacttgcaaac

SEQ ID NO: 1384 - DNA, 50 bp, Homo sapiens
gtcagcatcacaagacgcatgaaagaggactcatcgccagggcatggagc

SEQ ID NO: 1385 - DNA, 765 bp, Homo sapiens
acctctgccagattgtgcctatacaacgtgtaatgtggcggttaccctttttttggagaatcttcgtttgtcagtgtttctgaacaagcagagattgatgtctttttataaccttaaaggctgaaattccacaagccataagcaggtccagtccggtttcctggaggcccggggaggcctcattcccacttttgaagtgcagtccttgtttcttactctcaggcttgtcatgcctaattaaatgaaatttgtctttaactgtgacatttctggcacagccatggttacaaatttgatttacccaattatatcctgttaggaaggaggacagattcttacagatcctgtttacagaactaatgatcgtaaaagaaaagggtctcagcaaaggtactttgaagagtttttagctattattcctagtagttttgtagataaggccaattacatttgttgttttcaatagaatgattatttgaacatttccttgatgatttattatttcatatctatgttaggtttttatagtccccctcccaccctcacccccagaattctgaagagttagttggaagaaggaagaaggcaccattttaggaatattttattccagtttattgaatacagcctcctaaattgaggattagcgacagtaataaagaaaaaaaaagacctttagaaaattagaacattaagggtgaaatcagtttcatccagtcctggggaaaaattcctgttcctctgatcctgggttagttagcctgc

SEQ ID NO: 1386 - DNA, 94 bp, Homo sapiens
tgtgaaacggccattgcagctctgaacagttgtctacgggacctagaccaggcttccctcgctgcagtcagccagcagcttgctccccgtgagg

SEQ ID NO: 1387 - DNA, 500 bp, Homo sapiens
cttttgacaatgagagtaacccagccactgagtatccctctttgccttgcctgctagggggctcaaaacaaaactttgtgttcagtctgagttatcttgtattatgttttaatggtttagttttatttttcagtgtttttcatataaactgcctccaatcttttctctaaaggagtagaggtataaacatacacatagaggactgagtgatggtaggaccttgggtgaggagagggaggattagaagaaaacaattctgaaagaaagaaggagcacaagagggtcagaggtgagaaggatagaaaggtaagtgttgaagaaaagaaagtggaaaagtcttagaatatttctagctggcaggagaagggagagggagctggcctcagggaaaggtgatcttcctaaacaggtcctccatttccctttgggtctgggtctaggccggggccttgtctgaataggcttaaacatgaaagcgagcgttcttgagttctggtttc

SEQ ID NO: 1388 - DNA, 31 bp, Homo sapiens
aaaactgattgggaggtagctattaaaagta

SEQ ID NO: 1389 - DNA, 65 bp, Homo sapiens
atgggcagaatccaatacccgtttgctgtcagttatacctgtttgccagttagtcagatgctcag

SEQ ID NO: 1390 - DNA, 145 bp, Homo sapiens
tggtcgtgaaggtggtaaacccagccaactgtcaacgactctccagcaactcatcaaagagtcagccttttccatatttaggacatttctctcccccgtggagaagtcgaaccgctggatctacatagcgctttatctgggatcg

SEQ ID NO: 1391 - DNA, 82 bp, Homo sapiens
ggtctcgggaaaatgctgcccgcgacaacccactgcgggaccctaaatgtctcgacaataaggcctcctcggcacgtctctg

SEQ ID NO: 1392 - DNA, 96 bp, Homo sapiens
ggcccagcttcatggatatacaaactatacattcacatgggttccacacctagatgggctcttacatcatgtagctggtcctacctgggagagagc

SEQ ID NO: 1393 - DNA, 198 bp, Homo sapiens
agtacaatgcatactccttaggttcttaaactctaccagtctaacagaaagcaccaagatacagatgccaaagtcagaaaaaatacaaagcagctcagaatcaatatcatatatcttattcaaggtaaattttatgttagattctttgtctggcatttgggaggctaaattaacttaggaggctagagatcccatctc

SEQ ID NO: 1394 - DNA, 109 bp, Homo sapiens
catcaagtagtggtaccagacttcatagaggttatgtagaagaagccacattagaagacaagccatcacagactacccatattgtatttgttgtgcatggcattgggca

SEQ ID NO: 1395 - DNA, 567 bp, Homo sapiens
cctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgcaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggggagcgggatttttaaatggtggagctcatggtaaacaaaattatgtgtgcaaaatgttaatagagcctttctaatattcttgtgattaactctggtgacagttggctgagtgttcttgtttctgcaacgcctgtctttg

SEQ ID NO: 1396 - DNA, 152 bp, Homo sapiens
gggtccttacatcattcatcacattaaactgtaacatactgtcagaattcactgggcattagagtagctgtctggcttttgtgtagacaaaatactttctcaactccaccgcttgggcaaaggcaaggctgtgctgacccaatttccattcc

SEQ ID NO: 1397 - DNA, 88 bp, Homo sapiens
ggtctcaagctggacgaaggggagccccaggtcaccctgagcgctggggccgcagtgggaacttgcggcgatgtcacccctgccctgc

SEQ ID NO: 1398 - DNA, 237 bp, Homo sapiens
tctacaactttaggggacacaaggcagttcatagcagttgctctcctttggtttgtatccaactacactgcctggttgatcttctctctgaatatttcggtgctatctctttccttcagtttgcatcttcccctctcagaaatgtatgtcaatctaaaagtccaatcccatccactttctgtattggtcatttcatcatcttccagggcttcatccatgacttgcacctgtgtgacc

SEQ ID NO: 1399 - DNA, 115 bp, Homo sapiens
atgctgcgtaaggcctcaatcccactgaaagctggaagcagtgggacagaagggttccagagagaggttaaagaagaaagtgaagggggagaatatggaaatcatagggagatca

SEQ ID NO: 1400 - DNA, 192 bp, Homo sapiens
agtcactctggcatcgcctgcaacagcaaataaatgagtggcaaacaagctctcgcggagggtatttaaatattttatgtgactaagaagaatgagatacgtccatttgctgtgataagaaaagatattccacagtttcgtatttgttaagtattttcagcaaatcatggaacacgatgcaacacccgattc

SEQ ID NO: 1401 - DNA, 63 bp, Homo sapiens
gagggtctgggacgtcctcagggcagcggagtgacagaaatgcaaggtgtaccccaaccgcag

SEQ ID NO: 1402 - DNA, 113 bp, Homo sapiens
cgagactcccctcgactgttgttgggatggtggttagcgtggtagagccgtctgctttgagtcaccgggctggtctagaatatagaactgacagtccaaatgctcatcctttc

SEQ ID NO: 1403 - DNA, 81 bp, Homo sapiens
gatgcgcgccgtacatccggcactgggtctctgcctcctcccagctccttcgtgtggaaaagtgcttgtagcaggcgccct

SEQ ID NO: 1404 - DNA, 66 bp, Homo sapiens
tggagaccaccactgtccacgtgcgcaaagcgacgtcccagtttcctcacgcgtgggctgcagctt

SEQ ID NO: 1405 - DNA, 43 bp, Homo sapiens
caaggagattccagcggctgcccatactgtttgtgccaggcag

SEQ ID NO: 1406 - DNA, 95 bp, Homo sapiens
atgtgcaaatatcaccactaattccagaatatttaatcacctcaaaaagaacccccctgacacacacacccagtagcagtccatgccccacttcc

SEQ ID NO: 1407 - DNA, 96 bp, Homo sapiens
gtggaggatggctcataacacttctcggaatcctccatcaaatgtgcactccactctcctctccttctctcccctaaatccacatcaccagcttgg

SEQ ID NO: 1408 - DNA, 89 bp, Homo sapiens
attggacacacactactggacttggatcaaccattttgtcatctgggggtcgctgctgttctacgttgtcttttcgcttctctggggag

SEQ ID NO: 1409 - DNA, 135 bp, Homo sapiens
agaagtccacttggctctatcctgggtcctgaaggagaagcaagaagaaggtcttcgcagggaagtctctgctcaaagcaaaatctctttatggaatggcatgagctatctcattattaaattcaccagcagcca

SEQ ID NO: 1410 - DNA, 284 bp, Homo sapiens
tatggtactgttaagaaccctgagtttgcagtcatgttattttcatttttaacaatttaatttagaattcaaaaactttttatatgtttttcctgataaatagtgcttaaattacttgtcaatattctgttccaaagaatgcatacaaattggattttgtttttcatttgatgtgtgttaagagtggaaaagatgcataactgacgtgcatctggcatatctgatgtgccgcaactgccaacagttcagataactttatggtggtcacaggtcagtcataatga

SEQ ID NO: 1411 - DNA, 60 bp, Homo sapiens
tggaagcgccactaccagcccacgaaactctttgaggccagaaatagcgtcttgaccccc

SEQ ID NO: 1412 - DNA, 51 bp, Homo sapiens
ggacctcttcgaagggctgggagtagagagagaataccaccccgaagagct

SEQ ID NO: 1413 - DNA, 178 bp, Homo sapiens
gaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtc

SEQ ID NO: 1414 - DNA, 81 bp, Homo sapiens
tgcccttcgtgcagagatcacagatgctgaaggcctgggtttgaagctcgaagatcgagagacagttattaaggagttgaa

SEQ ID NO: 1415 - DNA, 357 bp, Homo sapiens
atcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtaga

SEQ ID NO: 1416 - DNA, 61 bp, Homo sapiens
tggactttgagaaaagccgaagtcagcgggagcaggaagaaaagctgctcatcagtgcctg

SEQ ID NO: 1417 - DNA, 70 bp, Homo sapiens
tgctcctttcccttatgtcaactctcccacaggctctagggaatcccttctcctctcttaatggcaagca

SEQ ID NO: 1418 - DNA, 47 bp, Homo sapiens
caatcctaaacatatttgggagctgcacacctaaaagaggagctccc

SEQ ID NO: 1419 - DNA, 33 bp, Homo sapiens
aggaggtggcaaaactaggcgactttccaaatc

SEQ ID NO: 1420 - DNA, 284 bp, Homo sapiens
cgtctcaacggctcggaatcgcaaccgcgccgccgctgccgccgccgtagctgcgctgctcccgcgcggctcccgctcggcgcccgctagcactggggcgcgaccaactgtttaccgagagaggggggatgttgcagcacccggcgaagctgtgtggctccgaagcggattttctggaaaccctacgtccccaagttcgctttcatgtaacaggtgcatgcagatggagaggaagacgcaagcgaagaagaaaggactgggcgaaaatagctcggcctgccgca

SEQ ID NO: 1421 - DNA, 58 bp, Homo sapiens
agatataattggttgtggacggctaaatgaacctattaaagtcttgtgtcggagagtt

SEQ ID NO: 1422 - DNA, 130 bp, Homo sapiens
gattctacctctgctctttccgcaatccaccaagccccgtaaacttgccagaagttacattgtgtctgcagttataatgtttaaaacatgctctcacttgaccccaggattctcattagctgggttaccc

SEQ ID NO: 1423 - DNA, 405 bp, Homo sapiens
ccctgtgtatagactttggagtggccctgggggagataagtgtgggtgggagagaagatcccaaactaccaaaagtttgctccatgtcacaacctgccctaggcctccaggccaatgtgaacagacaggcacaaggttgagcaggatggatggtaaatgccaagctgggtgcagtgacaggggcagtggcagtctgggtcgacctcccataagaaggagtcacaaggagacattgaagggtgggaggatttgaagaagggaaaaaaagaggttgtcctgaggctggagagctgagcacagtgtggtgttgacagggcctggcctaactggatgtcaacagtgaagtagaggggcatcatgggatgtcaggctggaaagggcagtgcaggtcccacacaacaggca

SEQ ID NO: 1424 - DNA, 112 bp, Homo sapiens
aatttaatgttctaccagaaagtgctatgcatatgtaagtatatttcttcagcttttatgccagaaattcatatttaaactaaaacagaaaaacaataggcacctcccacag

SEQ ID NO: 1425 - DNA, 302 bp, Homo sapiens
agagagtaatagcatgcgcaccctaaagttcacattcctttttcagcaatcactggataatccctggctcctgacattttctccatacagagtagaggttcatgatcactttttcataatactttaggtaattttaatatactgagggatagtgacttaggatttgctcacttcgtataagataaaaccaatgatgggcacacatttacctgtgtaacaaacctgcacgtcctgcacatctatcctggaactttaagttaaaaaaaaaccagtgaacacccaactagacatattcctgaatg

SEQ ID NO: 1426 - DNA, 201 bp, Homo sapiens
gtcctttagctctctggtgagtgaatagccctgagtcccagtgaaccaggtgttgatggctcttttgagactttggttcctgtcttcttagtttaaaagaatttaaacaagagacacggtgcagcattgaggagtttattgcaaaggaaaaagaatattttgaaagttaagtgcagagtagacagtacacctcgggagaga

SEQ ID NO: 1427 - DNA, 97 bp, Homo sapiens
cccgttggctgattactcggaagaaaggagataaagcattacagatcctgagacgcattgctaagtgcaatgggaaatacctctcatcaaattactc

SEQ ID NO: 1428 - DNA, 195 bp, Homo sapiens
agggcttcttccagacggcctcatccttcagcaccgatgacaggttggtgatgagtgtcgttccctgggcaggagatgcagggtgagagtggggactggactctaggatgctgggacccctgccaccaaacacacgggggacacacactgcctggcacacagctggactctgtcaactagtcctgcgcccgagaa

SEQ ID NO: 1429 - DNA, 201 bp, Homo sapiens
ggagactcattacaactcctgctgaagctcctaatcttcttcccttctcttctaccctttccccctaccctcacttggcctgaagacgttctccccagagtttaccttgctcccctggtgctatgtgtatggtgaacctggcactatggccgcgtctgggactggccagacaactgctgctggctctccttattccaggaa

SEQ ID NO: 1430 - DNA, 50 bp, Homo sapiens
cggagcagccaatccgcgcgcggcccatcagctgaccgcctttgcttaca

SEQ ID NO: 1431 - DNA, 84 bp, Homo sapiens
tccactctggagaggtcgctggctgcacgccgagccccccgggccaagctcatgattcccatggatgcccagtccaacaatcct

SEQ ID NO: 1432 - DNA, 674 bp, Homo sapiens
tgtccctcagagattggccttatccccccagcatgacttttcctaaggtccagatcctttccccaggaccacccatccctgttactttgtctgagtcccagctctttgttccctggtacctctgcaaatgtggcttcactgttgatctggtgttctgacccccctggggatcctttctgaccccagtgcaggtggagctgggcagctacatattttcggggaagtccacccagatacagggtagagggcagagagagttgcactgtgaggaaaagagcaaactcggattggtggaggcatgtggatacattcccactcctgggttgccaccacttcttgggagacttggccctcttccagttttctcccccagtagcacccagttcctcccataggccagtgcttttctagcatatcttcctttttcttggtgaagaccaagtcagtgcaatgatacctacctactgagcttggttataaacatttcgattcccgctttggctacaggatcctgatccccattctcatatctccaaattcatggacaaaggtttttgagaattcgtaggttaggaaaatgctgctttcctctgactcctgaggttatttgtttgtttatttatgtcagatgggtaatgtgccaacatcttgacaagatttgagggcggcacatc

SEQ ID NO: 1433 - DNA, 72 bp, Homo sapiens
attcctggggcacccctgacaaagggagtcagtgggccaccagatggaggaagactcggtgcaatcccactg

SEQ ID NO: 1434 - DNA, 79 bp, Homo sapiens
agaggtggcctccaacacagaaatgatccagaccagcaagacggagatcacagacctgagacgcacgatgcaggagctg

SEQ ID NO: 1435 - DNA, 82 bp, Homo sapiens
cccggtggcatacattgaatgcctagggcagaaaggaagtgggaatggcgaagatgtgacgtgcctcggtgttagatactgt

SEQ ID NO: 1436 - DNA, 50 bp, Homo sapiens
ctgccgcccgcctgcaagatggattggccgcattgaaattcctccgcgag

SEQ ID NO: 1437 - DNA, 39 bp, Homo sapiens
gtggcctcggaggattccgtgcttctgtatgacacccag

SEQ ID NO: 1438 - DNA, 196 bp, Homo sapiens
tattggctgctgagagccctccagaatgtagacgtctggtctggggaaactcaatggatttctgttcttggtacacgcacccacttatgtgttcatgtcccaccccccatcctcacagccattacatgaaagcatctgagtgttgtacaaggttaaagctttttgtgttaatctatcccatatggagcaggtatta

SEQ ID NO: 1439 - DNA, 127 bp, Homo sapiens
tcgaactcaccgtcctgtactcgagtgacgcacagacaccccccgcccacagcccagacgccccctccctcgctgccaccccgacccgtctcggagctggactgggtgccgacttcttcgcagaagg

SEQ ID NO: 1440 - DNA, 139 bp, Homo sapiens
ggcagtggccggataagaacagaatcttaccctgatagcagcactctggtcattgatatagctgaaagagatgactctggtgtttaccacatcaatctgaaaaacgaagctggagaggcacatgcaagcatcaaggtta

SEQ ID NO: 1441 - DNA, 37 bp, Homo sapiens
ccaactccctctgttaaaggcatctctccaactcggc

SEQ ID NO: 1442 - DNA, 490 bp, Homo sapiens
tgcatgttcccacgcagggagtatagtgcgcgccagttccggcaaatgtcctccccgaaacgctgcaccaagcacaggagctgtgcacagaccacccctcagtaacaggcacagcaggcgcgggtggaaggggtcattagggttcccctgagttctagcaggaacattccccagagttctagcaggaactatagaattcgttagtcctcagactggtctatagccctcatcattgttcacgtcaaaaccagcatgttgagacttgtattcatttgaaaaaaggaattgagggtttggcggcctttattttaacctgaccaagtgagggaatgctcaggcccttttgctctggtgccatagggcggggctgggcgggccaggcaggaggtgtggcatgggagacctgctccccagggcctggcctggggctggctgtacagaaacacagactacatctcaaggaccccaggagcttgcagtcccaacagca

SEQ ID NO: 1443 - DNA, 32 bp, Homo sapiens
gaggcggacgcatgcccggtggctctaaggcg

SEQ ID NO: 1444 - DNA, 239 bp, Homo sapiens
ggaggaaaggcccacttcgcccatcccctctaggttttgcttggagctgtggctggtttgaccatgcctcagaggtcaggccctcagccccccgactggctttggggccaatctcaatgccacctccagggtagacttgacctgcgtgcccccatctaccctggccctgatctccctttccccagccctaccctcatagacggagggtccagaggaggatgcgggcatctctcctccca

SEQ ID NO: 1445 - DNA, 50 bp, Homo sapiens
ggggaatgcaactgaaattgctaggagttgagtcaggcagctatgagcaa

SEQ ID NO: 1446 - DNA, 146 bp, Homo sapiens
tgggaaaaggctgtccctttgcatcccaaataaggcaatacgaaattgtaactggatgctaccatggacacccagattctatccaggagaacataaatagaagtgatgagaacaccctctccctgctggaaatacatgtggggtcc

SEQ ID NO: 1447 - DNA, 317 bp, Homo sapiens
tgtaacattccctctatctcaaatgtctcttcaaattactcccatccttcaaggctctacccaaatcctactccacagtacagcctcaccaccccctggagcattccacagactcccccacttgccatggtctctttcttctctcatcctgttatagtcattgtctctaatccacaaccctcacattattatcattcttgtcactatctctgctttataatttagaacattttaaataaattcagtctgctgaacatttatattttaaatagcatgagagctaccccataaatgtttgaatgcatgacatatatacc

SEQ ID NO: 1448 - DNA, 45 bp, Homo sapiens
cccatgagtggggagacttagtattcagcccgtgctttcagcatc

SEQ ID NO: 1449 - DNA, 74 bp, Homo sapiens
agatgcatgatccagctgtgtgttttcaatccttgggagggtgccatccacattttaacagtacctgtgcctga

SEQ ID NO: 1450 - DNA, 273 bp, Homo sapiens
gccactgagtttgggtggtgtctccggtaccagcaaggcaatggaaggcacactgcccatgcttgacatttaatgaacccttttcactctctatttgctgaaccaactctctaaagtttaggttgttaatctccagaagtggtggaattaaacacaagcacacacacacatacacacaaacaaaaactcacctgtagtcttactctttcctcaatcctaggattgattcccagccagcatcagacagcctccttagtcttttcctggagtgta

SEQ ID NO: 1451 - DNA, 203 bp, Homo sapiens
tttaacgtgaggtttcagtagctccttggttttgcctctttaaattatgacgtgcacaaaccttcttttcaatgcaatgcatctgaaagttttgatacttgtaacttttttttttttttggttgcaattgtttaagaatcatggatttattttttgtaactctttggctattgtccttgtgtatcctgacagcgccatgtgtg

SEQ ID NO: 1452 - DNA, 1050 bp, Homo sapiens
aagcccgtgccgtcatcttctttggtgaccaggagcatcccaatgtcaccgagtttgctgtggggcccctgccagggccctgctacatgcgagcactgtcccccaggcctgggtaccagtcctcctgggcatcgaggcccatctccacagcagagtatgccctcctctaccacaccctgcaggaagccaccaagcccctgcatcagttcttcctcaataccacaggcttctcattccaagactgccatgacagatgcctggccttcaccgatgtggccccccggggtgtggcttctggccagcgccgcagttggcttatcatacagcgctatgtagaaggctactttctgcaccccactgggctggagctcctcgtggatcatgggagcacagatgctgggcactgggccgtggagcaggtgtggtacaacgggaagttctatgggagcccagaggaactggctcggaagtatgcagatggagaggtggacgtggtggtcctggaggacccgctgcctgggggcaaggggcatgacagcacagaggagccgcccctcttctcctcccacaagccccgcggggacttccccagccccatccatgtgagcggcccccgcttggtccagccccacggccctcgcttcaggctggagggcaacgctgtgctctacggcggctggagctttgccttccggctgcgctcctcctccgggctgcaggtcctgaacgtgcacttcggcggagagcgcattgcctatgaggtcagcgtgcaagaggcagtggcgctgtatggaggacacacacctgcaggcatgcagaccaagtacctcgatgtcggctggggcctgggcagcgtcactcatgagttagcccccggcatcgactgcccggagaccgccaccttcctggacactttccactactatgatgccgatgacccggtccattatccccgagccctctgcctctttgaaatgcccacaggggtgccccttcggcggcactttaattccaactttaaaggtggcttcaacttctatgcggggctga

SEQ ID NO: 1453 - DNA, 151 bp, Homo sapiens
cctcaaagtgactgacatttattttaattttgctttgtttttttttattttctcccccattcctttattttgtgttattcctgactcacttgacactctctgatgcctgagagattcctgtttgggatttaatatccagggctgtgtttac

SEQ ID NO: 1454 - DNA, 90 bp, Homo sapiens
tgcttaaaaggacctgacacttacaacagtcaagttctgatagaagctacagtaatagcactaaccaaattacagccacttcttaataag

SEQ ID NO: 1455 - DNA, 83 bp, Homo sapiens
accaccctcgctggactcatcatcaaagtaaaaagtcagctccacccccaacagcttttagttgctacatcatgcatccacac

SEQ ID NO: 1456 - DNA, 187 bp, Homo sapiens
agctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcga

SEQ ID NO: 1457 - DNA, 69 bp, Homo sapiens
tgctcaatcttcgacttcatacgcttcattttttccttacctccatcaactaaataacgccctcttgcc

SEQ ID NO: 1458 - DNA, 104 bp, Homo sapiens
acttggcgtcaacataatgctggaaacacttacatctccaggcttcagtgcaacttccttcgcctgacttcccttccctcggtccgcgatccactcctgggact

SEQ ID NO: 1459 - DNA, 342 bp, Homo sapiens
tggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcacca

SEQ ID NO: 1460 - DNA, 83 bp, Homo sapiens
tttcatagtgactgacaggacattctccagagagcgacaaagcagagtggccagcaggcagtggtgttaagccttgggccttc

SEQ ID NO: 1461 - DNA, 189 bp, Homo sapiens
ctctgtcatggggtcttgagactgaggcttgggcaggaagatccaggtagggtcggggctgccctggccaaccggccgctcccagggagacaggactcagccaccagggctcagcaggcattttccgaaagcagggtgaaattgtctcttcccaggaaaaagattaaactccttgcaggctcttggata

SEQ ID NO: 1462 - DNA, 62 bp, Homo sapiens
ctgtactgtacgcaacaaatgtcagggccctattgatttgtctgaggtgttagtgaagggtg

SEQ ID NO: 1463 - DNA, 124 bp, Homo sapiens
ttccgtaaagcactcatcaatggtgatgaaaacctggcctgccaaatatatgaaaacaatcctcagctaaaagaatctcttgatccaaatacatcttatggggagccctaccagcacaatactc

SEQ ID NO: 1464 - DNA, 392 bp, Homo sapiens
gataggaggttaaaatgatcaaggatagtcagggacatgacaaaggtggcacatgtgcctttacagatttggcacgagtttaaccctgagtctttatttggaaaatggtttccagctataggaggatttaaacccctcattgtaggtgtattgctagtgataggagcttgcttgctgctcccccgtgtattaccctcgctttttcaaatgacaaaaggttttgttgctactttgattcatcagaaaacttcagcacaggtgtattatataaatcactatcgttcaatctcacagagagactcaaaaagtaaagatgagagcgagaactcccactaaaagtgaaaattctcaaaggagggaaatatggtgtgagaccaccacgtctcctgctg

SEQ ID NO: 1465 - DNA, 176 bp, Homo sapiens
aagttggccacaagcaccgtgagtatggcgtgggtcgccctcttccctgtctccctgctggacacccacccaccccttagcgcctgcagagaagtccccccaggagtccaggcctgggtccctgtggccctggggggtttgtggcgaccccaacacgagctctctgcgactgcacg

SEQ ID NO: 1466 - DNA, 81 bp, Homo sapiens
tgtggtacaagcgtcacagtattgcaattggagaggtgccagcttgccgtcttgtccaccgcagacagctgacagaggcca

SEQ ID NO: 1467 - DNA, 134 bp, Homo sapiens
cgggccctccgttattactatgataaaaacattatgaccaaagtgcacggcaaaagatatgcttacaaatttgacttccacggcattgcccaggctctgcagccacatccgaccgagtcgtccatgtacaagta

SEQ ID NO: 1468 - DNA, 29 bp, Homo sapiens
tattgatgaaggtgtcacaacggcaagat

SEQ ID NO: 1469 - DNA, 253 bp, Homo sapiens
ccaggtgatggtctttaattagagacttgaatattgaatcaaaaccacagaagattatgttattacagcacaaccctcaccttgaaacgtgaaaaatgtgttaaattattttgctacttttccttttagccaggaactattcaatactttcacaagtacctgtttaactcagcccactacactggccatcataaataaccaaaacgtgatttctttactttctttaaggaaacagtatctcgcacttccagtg

SEQ ID NO: 1470 - DNA, 63 bp, Homo sapiens
gcccagcctttggtcccttgatctggtgtcgggaatctgccctccgggtaatgagctttctga

SEQ ID NO: 1471 - DNA, 30 bp, Homo sapiens
aggcacaggcgggaaggctgcatactctcc

SEQ ID NO: 1472 - DNA, 152 bp, Homo sapiens
gcaacccagcgtagggaagaactgcttctggactgcacctgaggcagcaccaccggcaacggagccccgccacctgctgtacccgtccaccttctctggttgacctccctggggccagacagcccactcagagtccgtgctccctcctatgg

SEQ ID NO: 1473 - DNA, 186 bp, Homo sapiens
acttgcccagttacaacacatctgaaattctaaaggcccttcccctacctgtcgtgcaaatccccttccgtctagtctctggcctaaaaccagttgagatggaccctcctcctcgggaagtcctgcctctttctgaaggcagggtgcctgctgaatctggtccctgtggccctgtttgctcaaatg

SEQ ID NO: 1474 - DNA, 41 bp, Homo sapiens
ctggaacaagtgaactaggaaagagggaacgccaatccaag

SEQ ID NO: 1475 - DNA, 74 bp, Homo sapiens
gtgtggataagtatgggcagcctctcccaggctacaccaccaaggggaaggaggacgtgcactgctacagcatg

SEQ ID NO: 1476 - DNA, 92 bp, Homo sapiens
gcagacttgtaaacttctctttgagattgggagcctcgatgaaggaattagctcatcagcaattagcccacatggacggtacattgcatcta

SEQ ID NO: 1477 - DNA, 38 bp, Homo sapiens
cggccgccgccgacaggtgacgaagtggtaaaaactca

SEQ ID NO: 1478 - DNA, 784 bp, Homo sapiens
tcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtgga

SEQ ID NO: 1479 - DNA, 142 bp, Homo sapiens
acacacacgaccttgatgccctagtcctcacccaggtcctctgacctcctctcctcttccctcccagtggtcacagcaggcccagctgtgcccaccctccctccaaacggctcagcccaggaaaataaggagccggcccatc

SEQ ID NO: 1480 - DNA, 266 bp, Homo sapiens
ggctcttgacgaccttcagcagctcctccatgaccacggcgataccctggtagccgagaagccggcagatgacttgaaagtgtggaggtcccacgaagttccggtagctgccgtaaatgctggagtaggccaagttcaaagcctggaaaacagggcacagagctctcagcatggtccccgcacacatgtgcagatgaagaactgtgtgagaagatcactcaacacacacaggctcaggtgagcgggtctgagtctactgacttgta

SEQ ID NO: 1481 - DNA, 86 bp, Homo sapiens
aggagtgtcaggctcgacgatcacctcaatgcagggcagatcctggggatgcactctccagcgacaccgcacagagcttcttcccg

SEQ ID NO: 1482 - DNA, 28 bp, Homo sapiens
ttttgaggcagttcaagtggaaaaagaa

SEQ ID NO: 1483 - DNA, 69 bp, Homo sapiens
aaatgaccttttctagagccacctacaccaaacaaaggaattggagggttgatatggttctgcccttgg

SEQ ID NO: 1484 - DNA, 51 bp, Homo sapiens
gatcttctacaagaaactgctcccactgaccaagaactgggcatcccactg

SEQ ID NO: 1485 - DNA, 33 bp, Homo sapiens
tgttcccctatcaccgatgcacagacccagaag

SEQ ID NO: 1486 - DNA, 57 bp, Homo sapiens
cagtcgctgccggtcggaaatgaatgtccaggcagcgtggaagaggggctacacagg

SEQ ID NO: 1487 - DNA, 119 bp, Homo sapiens
ccgagtgcggttccggaggctctggctctggggaggacggtgactgtgagcaggagctgtgccggcagcgcggtggcatctgggacgaggactcggaggacgggccgtgtgtctgtgac

SEQ ID NO: 1488 - DNA, 53 bp, Homo sapiens
tgggtgtgagtccactttgcgatcgtcacactgaatctattgccaacatccag

SEQ ID NO: 1489 - DNA, 325 bp, Homo sapiens
cagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctgccatagcagtgaccaggcgcagccaacagaaacggaaagtcatggtgtccaacacgcctctctgtt

SEQ ID NO: 1490 - DNA, 168 bp, Homo sapiens
gccccaacattgaagtgccaggatcaaagccattcactagcatctcctcaaacacctgcctgccatcaccaccacaagtgccaggatcaaagccattcactagcatctcctcaaacacctgcctgccatcaccaccacaagcaccagtaggaaatcctcccttggtgc

SEQ ID NO: 1491 - DNA, 68 bp, Homo sapiens
tcttccattcgagctttgatttgcagcaattcctcccaccaccggctatttccatcgcccagccaggg

SEQ ID NO: 1492 - DNA, 545 bp, Homo sapiens
catttgggattgtgtagaggctctctctcagaagcatctttctgttattttaatgcggatagaaagctttacattctttgctaataacatctgggttttaatagcgcctccttgccctgcctgtctccggcatctctcttttttccctcttctccatctctagagaagccaccagaaaatggcatcttgcttttgactttctttgtgctgattcttttagagaacttagtgatccactttgcaatgtctcgtctcctaacatttcagcttgtttctcagagggcctgtactttgctttctaccagctctttcatcattttcattttctttaatgaaaaataagcaaaactgtatgatttctaggttgtcttcttctcctaaaggatattcttcttccggcctctcttaatctctcttctcagcaactcccttgatctcttttatcatcaatttattgtcaataaaagtggctttaggaagcctcctgttacctggcagggttccagctttctgacactttcctatgggacccacttgttatgtca

SEQ ID NO: 1493 - DNA, 165 bp, Homo sapiens
ctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctg

SEQ ID NO: 1494 - DNA, 107 bp, Homo sapiens
tgagctctacgagaaggttttctccaggcgcgcggaccggcacagcgacttctcccgcttggcgagggtgctcacggggaacaccattgcccttgtgctaggcgggg

SEQ ID NO: 1495 - DNA, 81 bp, Homo sapiens
tgcgtgtgaaggctgttaatgcagctggtgccagcgagcccaagtactattctcagcccattctcgtgaaggaaatcatag

SEQ ID NO: 1496 - DNA, 78 bp, Homo sapiens
atgtactttgacaaggagtgtgttggaaacgactgccagcctgtgcctgctgccaactccactcagctacaaatagaa

SEQ ID NO: 1497 - DNA, 93 bp, Homo sapiens
caattcccgctcatacacagcaggccagaaagacttccacgctgcacacaacgctcagagcagaacgtctgggaatcaatctatccaaatttg

SEQ ID NO: 1498 - DNA, 91 bp, Homo sapiens
atgcttctgattttctacccccgtatcactttctatttctctgcagcgtgcatcgatcgccctggtgggagcttagaaggcggcaggcgaa

SEQ ID NO: 1499 - DNA, 29 bp, Homo sapiens
tttcctcaggcttaaacctttgccactga

SEQ ID NO: 1500 - DNA, 145 bp, Homo sapiens
tgttgcttctttggaccacttggtggcactagatttaccttcaggcaagccactggatgaaccgccagcatgacttcgggtggcactgccatcatccacactactgcttccactgttgtgcctgaatttggatggctttgactca

SEQ ID NO: 1501 - DNA, 49 bp, Homo sapiens
ctctaccctttccaaaatcaaggtgaaggcaagacggcctcttccagct

SEQ ID NO: 1502 - DNA, 142 bp, Homo sapiens
aagcggcagagtcacccagagcctttgctcagcggagctcaggctgactctccttctgaactcagttcaaaccctcactcctctgaacaccctcagccgccgcacagggagctccagggctcttgggtctttcacagtcctc

SEQ ID NO: 1503 - DNA, 35 bp, Homo sapiens
gagaacaagacttttggtgggactggataaagaca

SEQ ID NO: 1504 - DNA, 456 bp, Homo sapiens
ctcaccctaagaggccagtattacccagacaccaaattcagacaaaaacatcacaaaaaaactacagaccaatatgacttatgaacagatgcaaaaatcctcaacaaaatacaagcaggctaaatccagcaacatataaaaaagatcatatgctgtaaccagtaaaatttatctcagaaatgcaaggttggttcaacatacaaaatcaatcaatgtaataaagcatactaaaggacaaaaatcacatgatcatcttaataaagaaagaaaaaaaatttgacaaaatccaacaccttttcgtgatgaacaaactagtaacagaagagaatttcttcaatctgataaagggcatccacaaaaaacccatagataatatcatacttagtgatgaaagactgaatgctttcccttaagatcaagaaccagacaaggatgttgttggttcttgctagtcta

SEQ ID NO: 1505 - DNA, 91 bp, Homo sapiens
atgattaaaggggtgttgtggtcttgttttaaatacatcactggagatgtagaggtctggtggggacagttgaagcacaacctccacaaag

SEQ ID NO: 1506 - DNA, 115 bp, Homo sapiens
tgagatgtcgcggtagcaaaaatagagaaagggtagaaaaaagggacattaaaattaaaagcaaaaccacaagaagggaaagaccgcaactcggacagcccagcgacttccaagt

SEQ ID NO: 1507 - DNA, 53 bp, Homo sapiens
aaaatcattagtttggaccttcctgtggctgaagtttacaagaaagtctggtg

SEQ ID NO: 1508 - DNA, 214 bp, Homo sapiens
aatttcctgaaactgggctaattctttgtagaaatgtgaacgctgaatttattaaaaaataataataaaacacaggaaacaacttacatgtacataggtcttgaagtgagtgaagcggctgtatttttttggggggggcattgcttttgtttttgtagaagagattgagatgatactctattctaatcaaaattagagatttgtagtgggacca

SEQ ID NO: 1509 - DNA, 146 bp, Homo sapiens
ccatgggaactccacaccatgagaacagggcttcagagaccgcagaaactccacaccacgagaacagggcttcagagaccgcagaaactccacaccacgagaacagggcttcagagaccagagtaactccacaccgtgagaacagg

SEQ ID NO: 1510 - DNA, 1112 bp, Homo sapiens
tgctcctgaatggaatggtcccacagaaaaagcacaggatacagcacaacataagggcacctgttacatatgaagtgagcaaaacatactagcattttctatatgcataatggggaaacctgcataggttagagggccttttacgctcatttaaaaatcaggcaagttgtctgtaacatttttcaataatctgggaagcactgcaatccagtgtacgatgtgctgattagtgttgtctttgttggcactgacagtcttgcatggtcatatgccagtgtttttgctttagcttttctttgaataaaacagatttaaatgcatttagacaatacgtatttgtaagctgtttacatacactaaatttaagagattcaatattagagtttctttgtttctttaaacactacagagtgcaaatcaggttcttcacaacagattgaatattgagcagttctttaaagaaagagggggaagaaaaaaagcccaagtgaataaaacattgaaactattccccttcgaaaataaattctaaaatgatgtggaatgtgaaataaggttttaacataggtgatccaagtttatagttagaaacaaaaagaagtccttcatgaaataaaggttacaagaacacgttgcctgttttcccccattataaactgagaagtgggtaaagacgatgtttcagtacgaaaataggtgactacaggatcagcgcttcatctcacatgctgtacccaaagccaggctgtggctgtccatacggtggtgcggtataaccataaccaaaaggtgcctggggagggacggcaacactgggtcctgctgtcagcatcaactggggctgacctacagtagaagaaaacaaaaaggagcagggggcaggggcaaggaggcaggacaaactgttagcatttagaacactccaatctcctccactctagcaacataatctcaacctcaaatgagttgtatggggggcacatttgattgctacaattttagcatgacagtcttactctaagaaggttcctacctaaaaagccaacaaacagtgcagggccaaaggccagaactgcttatgactgaacaccgtatgcctgacactctgtata

SEQ ID NO: 1511 - DNA, 123 bp, Homo sapiens
gcaggggcggttccattggctcagcttcttccatttgtttcctctctgggatggaattcaggaagggagagtcctcgaattaggagtccttgggtaaatggggcaagtcagcccagtcacttt

SEQ ID NO: 1512 - DNA, 123 bp, Homo sapiens
ggccccgtgccttctgactcacagcagctcaacaggaaagcatctgatcatgcccacagccctggcatctggcccacaggagtggcacccctccccaagaccttccacacagtttctatatta

SEQ ID NO: 1513 - DNA, 253 bp, Homo sapiens
caggagaccatgttctctgtcctcaggcagatcccagctggcctctgtccccgggctgcaagctgacagcaggcccgggaggcggtgaggccctctgccctggccttgaggagaaggagtgcgtgtgtgaggcgggggtgcattggccctggagtagggccagggcccatcaccagcaccaggctgggagggatttaaaaccagggtcctatctctgagccaccccatggggaccctcgatcccatcctgtta

SEQ ID NO: 1514 - DNA, 225 bp, Homo sapiens
cacacatctattcataggtgaaattaactggaaggaaactagcaaagcatttgcctttggggtcagcacaggagcagaggcccaggcagggccttgctttgacacacagatgatgggtcacacagttgtcaccttgacagaagagtaacagggacagcacaccagtcactctaggagctgaggccagaggaactcaggtatttccttctagaggtagtaagtcca

SEQ ID NO: 1515 - DNA, 136 bp, Homo sapiens
tacgagtccatcagcaacaggggccccttcttcggctactacttcttcaacgggcttctgatgttgctgcagctgctgcacgtgttctggtcttgcctcattctgcgcatgctctatagcttcatgaagaagggcc

SEQ ID NO: 1516 - DNA, 370 bp, Homo sapiens
gaagctactatcatgggcgtttagagttatacaaatgacacttacaaaaaataaaagaccaagacacccagagtgagatgcatgttggggacgggggaggctggcagcaggggggccccggcggctcaccccagggctcccggagggggcgacgcctggcttcatccacccgggaggcccagggagcaccaatcacagcaggggctctggcccaggtgtcggcagcccaggcccagggctggggctggacgggaaggacggaaagagggggctgagatgcaccccctggggagggtgctgagacgccccccgccagatcactcgctactacagccaggcttgcctgggacgcctccagcaataatatttc

SEQ ID NO: 1517 - DNA, 101 bp, Homo sapiens
agtgagcacacccaggccgacggctacccagatgtatccagtgggtacacccacgcccacggctacccggatgtatccagtgggtacaccttggcccacag

SEQ ID NO: 1518 - DNA, 69 bp, Homo sapiens
tctcatcggatcagatcgagcagctccatcggagatttaagcagctgagtggagatcagcctaccattc

SEQ ID NO: 1519 - DNA, 194 bp, Homo sapiens
ctcattcggagatgcctgccttctgggaactgctcacctgctatttcattgggagcctctcctacccccttcaccccctccttacccatacctaaaacatataaagtgaaattgcgaagtctcctcagaacagaatcagttgtgaaaaacctcagcataacgggctgcccagatcggggactgccagataccta

SEQ ID NO: 1520 - DNA, 113 bp, Homo sapiens
acttatctacgaagggcgacgcttagtcttagaacctggaaggctggcacaacatttccctaaaactactgaggaaaaccctatatttgtagtaagccgggaacctctgaata

SEQ ID NO: 1521 - DNA, 1651 bp, Homo sapiens
ggggcacagcccttattgttagctaaaagttagtttcgggccttcaaccttttagtctgcaaggtaacgtcatattcaactgcctaatgtgccgtttttaaccataaaatggcaagtcaattatgtggcaatgtaaaatgcttgcacaactccactgtcattctcagagatttccattgggaagccatgcctactttatattaacacatggctaggggccaaactcagccagtgaaatggattacatatcggagtaacacatatacaatcatatttacacagatacacactcatgccacacacgaaagaaaaaaaaaagggagaaggaacaaattttggaaaacgatgccaaggatgctacactacatgaaactacatgactttttttagcaacagtaatttccaggcctttacataatattacatggttatggttcaattattagacagccaggaagtaatcccgagccaaaacaaaggaaggttgtaaagcctcattgtagacaaggcctgagcatccacagagaagatacaatgtttatgtgaatcctggtgtgcccaagtgtgatctactctcttcactgactactctgagtgctgatgagaatatatatattatcctctgactggcttgaatagctaagacaatacagaaaggtaacagagtggtttcacaccctcatgtgcttctgaaataaaaccatgggctcattagtgggtagctcactatctgtggcaaagactagacattttatgcaaaacacaaccactgcaaacccagcccaaagatgcaaaactctcagctaggatacttacccctcagctaaaaaacctgaacagctatctagagataaacccaggttctcagggaaaactggatgaggaaaggttacaaaataagcctgcaactcagctggaaagaggtcacttcaattttcaactcatttttttttttttttttttacctttggcaaggggtatgatcatttcttggcctgcaagcacaatcatgccaaccattaatgtggacaatgtggaaaaaaccctaaaaatccctgcaaagcccctgtcaagacatccaaatgccgcttgctaacagtttttgaggtacctatttgggagagccaagtggaactcttgaagcaaaataagtgtttcccagccttcacatcctaacactgtcaatgaactctcttaagttgagtgaagtggaagcgtgctgagttactgaagtgccaggtctttaatccaatcagctcacaacctctttcctgacttttgcgatatagattgtcaataaaggttagccgtcccttgaatgctcatggcaaagaaggtaccagctggccctggctagcacacagcatgattaaccatttctgagcaccaatcctaatgtcctttaagaatcaccccctaatataagccctggcaggaaatcagctgcttcttgatcccaactttttatgaaagttagaatggtaatagaatttgaattttcagtaggaatcagttctcttcctttccatgctttttcttccttgacttcctttggattcaaacatctttaattgagcagacagggaatctgaaaaggaaggttttcatcggagcccattctcagttccttggcattctagggtcagacctc

SEQ ID NO: 1522 - DNA, 58 bp, Homo sapiens
atgggaacagagatccaatattgtgtgactacaaggaaggagtcgaactgagtgtccc

SEQ ID NO: 1523 - DNA, 106 bp, Homo sapiens
tattttactgtcaatgcccatgggactacaaaagactattgaacataaggggaaagcaggagctatctggataattcagccaatggccaatacttcacctgttctg

SEQ ID NO: 1524 - DNA, 118 bp, Homo sapiens
ctgatatcggaagtggaatcctgcaggaagagaaagtggggcaaggccgagggcataaatgtgtgtttcgaatgagaaaaaacaaattgcttattcggacctctagcaactgccaata

SEQ ID NO: 1525 - DNA, 145 bp, Homo sapiens
tgtcccacgggttctggcctttccaccagtgcttccgtcccacacgaacaccttagagctccgtggcagcgtacggccacgtttcctttcccacacagcatctggctttgcctggagggaacgatggtctctgtcgctgctcttg

SEQ ID NO: 1526 - DNA, 407 bp, Homo sapiens
cttctccagtacatatgccacattgttgtcagcatgatcatatttttatttaaaaatactttacatatgtttattgccaaatattagaaaatacagattcatggaaagaaaaatcactgtcccaaggagatcactgcatggtgagattaaggggtgattttaatttttaaaaatgtatattttttcctgtgtagagtagtaacacccattgaaaacacaatcccttgtaaagtctctaattctgtactccgcatctagctgatctcttctttctcagatattttacaatttcatttatcaccacctttctctagcctttacccgtctcttcaatatttacatatgcagaagtttctcctaacaaacacctgcctctgcctcagttctgctaccaccctgttgctttc

SEQ ID NO: 1527 - DNA, 85 bp, Homo sapiens
ctgtgggacatcaacgcccacatcacctgccgcctgtgcagcgggtacctcatcgacgccaccacggtgaccgagtgtctgcaca

SEQ ID NO: 1528 - DNA, 221 bp, Homo sapiens
gagaacccagataaggtagctaatacataaatctgaaacaaaatgcatgactatagaaaaagagagtcttgaaatacgggcaggttttcaacaaggggagagggaagtgattaggtagtgatactccagatgaagtaaaacctgggaagcaaaggctctgagtttcaaaaccacagggtgtgttggaggtcagtagcacagtttggctgagatgcatggta

SEQ ID NO: 1529 - DNA, 312 bp, Homo sapiens
gcagaagcagttccctaggtctaggtctccaggacctgtccacagtcactgaaacgccttctagaattgatctagtggaaaatctagatgcagtttaggtctttggcactgtgcccatctcctttaagaactgtgcagtgtggcttggaagaggaaatgtggtccctttgatgggagaaactgaaggacctttttgaactcaaaggagctccagggtttggaattgggggcagagaaggctccaggctgctcattccatcctgggtgagccgaacgggtcctggctgatctgagtgcgaccttcccagtctg

SEQ ID NO: 1530 - DNA, 100 bp, Homo sapiens
catgcaatccacagtagtgactcgacttcatcttcctcctctgaagatgaacagcactttgagaggcggaggaaaaggagtcgtaatagggctatcaata

SEQ ID NO: 1531 - DNA, 1046 bp, Homo sapiens
gaccagcgctcacaggcaagttcctctaagcttccattctgctgactggtggcttccatttaaaaggagtcttttaatcaagccactttcacagaatttaaaacaaaccaaacacatgtaaattgcaaaatacaaaaaggtaaatttataagtaaaaatgaccaaacccacaaaactggagtatttcgaaggttgagggttcagtggagggtgtaacacgaaaggaacttcacaactgaaagaaatcattgccgagtttcctccaggcagcactgaaatgaatggagaaccttctctcgaacatctcacacgttaaaaaaaataaatatttaagagatacaaggctcagattggttttcatatacattgcacttgaagtttaagacccaatacttgcaaattaggtctggtatggtctatgccattaaatgaatacattgtgctcaccaatatcattgactagaaacaccacacgtttaatgcagtgccatatgcactctcctttttacaaggcaatcacagattgcaaattccatagggctgtggcaaaaaacagtcatctctattctgtagtaacaaacaaacaattttggctcactaagattgaaatacatggcagacaggtattcattcttagatgactatggatttcgaaataaacttcataaactgaggtgaaaattccaatatatcgcagtgtgggaaccaagacttttcattgccttttgctcagtaagattgtctacacaaactgccacgggaggaatgacaagcagttgacccactggtgatacacacacgtgtgaccatgtaaacacgccactgcaggacggacgagcgtgaccgtgaagcgtggccacgccgcgaccccacttagagtgtgacctctctataatcactgctgcttttcttgttttgtttttttttttaaacacagccctatttttaaaaatcttttggataaatattattcctattacaccatacttcatgtttgttaagcaccatcaacctacctcctttgggcactgacacaaaactgcggg

SEQ ID NO: 1532 - DNA, 307 bp, Homo sapiens
gacccagctctgatagggcttctgaggtgccagaaacctccagctggaatatcctgccttcaggacacatcagacatctggctgttcattagtccaatgttacaagtcctgcagtccacctcccattctatctggctccctgctctaccagagacaaatccaccagagccataacagatgcgctgccgggtccccatcagcatctgcactgagacctaccacgggacaaaccaatgatgaaaaacccaaagtccagaaaatgaaaatggtctcagagagactggccaatcctatttggggtcctcta

SEQ ID NO: 1533 - DNA, 33 bp, Homo sapiens
ctgtccattcgctgtggcttggatcgcttcaag

SEQ ID NO: 1534 - DNA, 106 bp, Homo sapiens
tgggtcctccactagctctcgctctgcatcaacctccaaatcgagctctgcgcgacgatccaagtcctcctcggtctccaggtctcgctcgcggtccaggtcttca

SEQ ID NO: 1535 - DNA, 168 bp, Homo sapiens
ttgtcattcaactcacaagtctagaatgtgattaagctacaaatctaagtattcacagatgtgtcttaggcttggtttgtaacaatctagaagcaatctgtttacaaaagtgccaccaaagcattttaaagaaaccaatttaatgccaccaaacataagcctgctata

SEQ ID NO: 1536 - DNA, 28 bp, Homo sapiens
tctccatgaagccaaacgtgggtcctgg

SEQ ID NO: 1537 - DNA, 185 bp, Homo sapiens
catagctaggcagtgttggagatcagcaggaactagacacaatgaatggatatggcatcaatactcatgaacatgccattcttccagcagtgcttggcaactcaggttgaggaacagagaaggtggatggcttaggtaatggaattggatgctttttaaatgtcagtggctgtcaaaactgtata

SEQ ID NO: 1538 - DNA, 85 bp, Homo sapiens
agggaagccaggttgttcatggacattcagtggaagaattaaggcaattaaatgttaagttttgcagggctggtcgacaagagaa

SEQ ID NO: 1539 - DNA, 28 bp, Homo sapiens
ttgggtgtttgcgcacaagcagccaacc

SEQ ID NO: 1540 - DNA, 96 bp, Homo sapiens
gtttgttgaaaagacgcctcccagactcttcactcacgaagtgtgttacaaaaactctcccggcaactgtcctgaccctcaccaatcacgctacag

SEQ ID NO: 1541 - DNA, 621 bp, Homo sapiens
tgcgcctgtgtgctgaatcactccatttctttctctttgaacatcatcatcacaatctgtactgtcatcttcgttcaattccctgtcagattcagcagcagcttctcttacagcttcctctggagtttcattgggtggaataaatccattgttgttagatacatttgaattatccttgatatcatcttcgatgtatactttctgatggcacattggacaagtatcttgaatgtacagccatttccgaaggcaaagtgcatggaaataatgattacacggtgtaatacgagcagatgttgtaaactcatgatagcagattgcacatacatcatttatttcttgtaagcggctcccttttatttcaggaagtgaattaattttcttcacagcagtcctacgattcataaatgtcttccagccatttttggcttgtaagtagatgttaaaatatgcatgtaggcacatcataaaagcccgaattttacttcccgactcaaacatcatagtgtaagccccatttccaaacattacaactccaaatataaattcaataatactgcctgttgaacgaacgtagtagacataatcgtcaagcttttcccagaggacattatagtagcc

SEQ ID NO: 1542 - DNA, 81 bp, Homo sapiens
ccctgctgcgcgtgtttggcggcaatgtcaccttttgttctgtggtcagttggtcactatgtgcttacactttaccgctag

SEQ ID NO: 1543 - DNA, 124 bp, Homo sapiens
ggtccaccaaaatatactaaatctgttctgaaaaagggagataaaaccaactttcccaaaaagggagatgttgttcactgctggtatacaggaacactacaagatgggactgtttttgatacta

SEQ ID NO: 1544 - DNA, 959 bp, Homo sapiens
ctttctgccttaaaccctggtgctcacttctcttctttactaataaatgttctttgtggcatattattatttttccataatagggcacttctgtctgccttaagaacctgttttggtagatatgctttctcctcaatgattttcttaatggcatctgggaactcatttgctgcctcttggtcatcaggagctgcctcttctgttatcttaacatttttaaagccaaacttctttctaatattatcaagccatcctttgctggcattaaattctctagatttagatccttcaccttccttttgctttaaattgtcatataatgaccgccttttctccaatcatattagagcctataggtacgtctttcttgtagcaatactgcacccacataaaagttgcatttttaatacgagataaaaaggtatatcacaaaaagtgtaaggtttgctggtatagatgcagtaatggcttcataaattttcttaattttttttaacagtggtccttatgctggattcatttatcttgaaggatgggcaactacagctgcagaccagtacacatcaagcaatttaactttttcttgtaatgtcatgactttgctccttgggagcacttccagcgtcactagcgggacttcatatgggtcccttggtattattgcaaggtttatggttgtactaaacatgatgaaaaataactgagaaccatgagagatcactttttactacgatacacaatttactggagagatgaactgcccatgtggagatgataaacatcacatggcattttaagtgaatacagcacttgagctcacagcaacagcaacaggaggtagctctgaaattatggtagtagtgcagtatgtactatagttaatcttatccagttgtaatttagtactgcatctttatgtttgtctcaactgcaaatggctccaatgtatagtctgtgta

SEQ ID NO: 1545 - DNA, 252 bp, Homo sapiens
catccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctg

SEQ ID NO: 1546 - DNA, 29 bp, Homo sapiens
tataaatgacaaggtcggctcagctctca

SEQ ID NO: 1547 - DNA, 390 bp, Homo sapiens
tatacccgatttagcagtgtcagcgtattttttcttctcatcctggagcgtattcaagatcttcccaatacaagaaaattaataaaaaatttatatataggcagcagcaaaagagccatgttcaaaatagtcattatgggctcaaatagaaagaagacttttaagttttaatccagtttatctgttgagttctgtgagctactgacctcctgagactggcactgtgtaagttttagttgcctaccctagctcttttctcgtacaattttgccaataccaagtttcaatttgtttttacaaaacattattcaagccactagaattatcaaatatgacgctatagcagagtaaatactctgaataagagaccggtactagctaactccaaga

SEQ ID NO: 1548 - DNA, 128 bp, Homo sapiens
tttgcatccggactggatttggatgcagccaatcctcctttggctgatggaatagtctcccctccccacagccccggcgcgcccctccctcgcgcgcctcgccgcctcccgccgcagaacaggagctg

SEQ ID NO: 1549 - DNA, 1704 bp, Homo sapiens
ggtgctgggcctactaatgacttcattaaccgagtcttccatacagaatagtgagtgtccacaactttgcgtatgtgaaattcgtccctggtttaccccacagtcaacttacagagaagccaccactgttgattgcaatgacctccgcttaacaaggattcccagtaacctctctagtgacacacaagtgcttctcttacagagcaataacatcgcaaagactgtggatgagctgcagcagcttttcaacttgactgaactagatttctcccaaaacaactttactaacattaaggaggtcgggctggcaaacctaacccagctcacaacgctgcatttggaggaaaatcagattaccgagatgactgattactgtctacaagacctcagcaaccttcaagaactctacatcaaccacaaccaaattagcactatttctgctcatgcttttgcaggcttaaaaaatctattaaggctccacctgaactccaacaaattgaaagttattgatagtcgctggtttgattctacacccaacctggaaattctcatgatcggagaaaaccctgtgattggaattctggatatgaacttcaaacccctcgcaaatttgagaagcttagttttggcaggaatgtatctcactgatattcctggaaatgctttggtgggtctggatagccttgagagcctgtctttttatgataacaaactggttaaagtccctcaacttgccctgcaaaaagttccaaatttgaaattcttagacctcaacaaaaaccccattcacaaaatccaagaaggggacttcaaaaatatgcttcggttaaaagaactgggaatcaacaatatgggcgagctcgtttctgtcgaccgctatgccctggataacttgcctgaactcacaaagctggaagccaccaataaccctaaactctcttacatccaccgcttggctttccgaagtgtccctgctctggaaagcttgatgctgaacaacaatgccttgaatgccatttaccaaaagacagtcgaatccctccccaatctgcgtgagatcagtatccatagcaatcccctcaggtgtgactgtgtgatccactggattaactccaacaaaaccaacatccgcttcatggagcccctgtccatgttctgtgccatgccgcccgaatataaagggcaccaggtgaaggaagttttaatccaggattcgagtgaacagtgcctcccaatgatatctcacgacagcttcccaaatcgtttaaacgtggatatcggcacgacggttttcctagactgtcgagccatggctgagccagaacctgaaatttactgggtcactcccattggaaataagataactgtggaaaccctttcagataaatacaagctaagtagcgaaggtaccttggaaatatctaacatacaaattgaagactcaggaagatacacatgtgttgcccagaatgtccaaggggcagacactcgggtggcaacaattaaggttaatgggacccttctggatggtacccaggtgctaaaaatatacgtcaagcagacagaatcccattccatcttagtgtcctggaaagttaattccaatgtcatgacgtcaaacttaaaatggtcgtctgccaccatgaagattgataaccctcacataacatatactgccagggtcccagtcgatgtccatgaata

SEQ ID NO: 1550 - DNA, 237 bp, Homo sapiens
ctctgtcttgggaggctatgaattaagtcaatgggctcccttcctttctgtttatcagttggatttggtcagtggggagtccaggcagggatctgcaggaggaaggacattgggagctgggtatttctctcctggactcactctgtatgagtcactacaggctggctgtgttcttcaacagaaggttattgctcttcccaaggtgacagctcctatgggactcactttctaacaggg

SEQ ID NO: 1551 - DNA, 147 bp, Homo sapiens
agcacgccattaattgctgatgcttgagtacagaaagaagagaaagaataggattccctttaggcccacggtttgagttacattaagcctgtggtcatttcctttaagacctgggaacatgggcattgctcattttcatgtactatt

SEQ ID NO: 1552 - DNA, 35 bp, Homo sapiens
ttggctccccagtacctaggcatgttggattcaga

SEQ ID NO: 1553 - DNA, 214 bp, Homo sapiens
cccaaggtgctgacattcccagaatacatcaccagcttgtcagactccggcaccaagcacatggcggctggagtccgcatggagtgccacagcaagggacgatgcccctcgtcctgccccctgtgtcatgtgacatccagccctgacacccctgctgagccggttctgctggaggtgaccaaagcagcccccatctatgaactagtgaccaaca

SEQ ID NO: 1554 - DNA, 30 bp, Homo sapiens
tgacaagctggtccgtgatatttatggagg

SEQ ID NO: 1555 - DNA, 2166 bp, Homo sapiens
acgtgtcatccgtcagtgctccatgcagtgctccaccacggcatccgccactctgccaccagctccgcggggatggacgcacaggccccagtcatggccctgccctgaggagatgctggtcgtcttcctgctcattcactcccctgtgctgcactgctggggtcagacaaggctccatccaagaacccatgacttcaaaagaaagaaacctttgtcctcaaatttggtaacaggcaaacggtctgcgtggaagccctgtctgcagcctctgctcactccaggacgtgctgccctcactgctcctctgatgtgcccccggctcaaggctgagcattcccgtatccacgcaggaaggccgggggactggctcccaaacagcggccaggaccttgggggcacccagggagactggggccctgcacctcagggctttggatccaggtctgggacgagccctgggaatcagcatgggagcagtggcagccatcctgtggccctgaggggagctggctggaggacaacctgaaatgctgagggcagcaggaggaaacacagaaggaacctgcgtcctgggtgacatcccggacctgctgcactcgccggccctggagccacctgcctctggcttcatgtgagctgtcacactgttattattatttcgttcctcaagtaggggtttcctgctccttgcagccggaagcagtaagtggtagccaccccacccctgcagggcagtcttctgatggctctgagctccctgaggtgggggcgaggcagggtctgtgctccactctgagggcccagtggagcagcaggtgttcgaacacatagggtttaccccaggcagaaaccaccctcataagggcatgagacccaggcagagtgagctctctggcctcttggtattttcttttgtgtctgtcttctcagcagcctatgagctcctccagggcaaaaaactgccatcatgctaaggggttctggaccctggggccaggcacagggccagggacagagtgggcaggtaacgaaggcttgctgggcaccgtgggagagaagggaacggaggcattgaggggcaagagaaaaggagaagtggaaggccagacaggcagagaaggaaaggttcgtggagagcagtctcttcatggggacccaaggaggccccaccagagaggaactgaggctgtgaaatggaaggatggaggcctgagggatccaggccagtggacaagtgagcccgagcagacggaaccatccccatgcctatctggttgtctcctcctcctcctgctcctcacccccttcctcctcctccacctcctccttctccccctcctcctccttctccccctcttcctcctcgccctctccctccccctcttcttcctcctcctccctctcttcctcctcctccccctcttcctccccctcttcatcccactcttcctcctcccctcttcctccccctcttcctcctcctccccctcttactcctccccttcttcttccccctcttcctcctcccctcttcctcctcctcctcctcccccttccttctcctcctcttcttcctcctccttccccttcctcctcctcctccccctcttcttcctccttctcctatcctctttttcttcctcaaccttttcctcctcctcctcctcctccttccccgccttacccctccttccccacactctgaaatgagcacatggctcagactgagaggacaaacctccagctgaatttagttgtagctgtggttccccaaaatgctttgaggattcatcagaaccagtagctgcctctctgcttcctcatctacacacctaattttgtagcttcagaacaggtgtgactcaggcagaggaagggctacacaggtgtcactgtgcccacccctagggagactgctacagacagacttcccggtgggacccggcccccacccatgcatggtggccacgggcatgaggagggtgataatgacaaggggagccacgatgaccacagggtttatagagatctcgccatttgctgagcaatgtggaggaacgttacacacaccatgtcgcctcccccgatgcctgcagggcaggtatcattgccctgcattctattgaggaggaaattgagttggaagtgcccaagatcacgtcgtta

SEQ ID NO: 1556 - DNA, 122 bp, Homo sapiens
ctggtgtctctcaaaagcctgatcctgccaaaaccaagaatcgccgcaaaaggaagccatccacttctgatgattctgactctaattttgagaaaattgtttcgaaagcagtcacaagcaag

SEQ ID NO: 1557 - DNA, 112 bp, Homo sapiens
cgtggagggacatcaaaattactttcgtcactgctcctatctgattctgaatcagaccagggatttctcttctttccttttttgattggcttaaatgccaatgtagtttgtt

SEQ ID NO: 1558 - DNA, 40 bp, Homo sapiens
gctggatggggcagcatctcaatcatatagggcacaggac

SEQ ID NO: 1559 - DNA, 99 bp, Homo sapiens
tccaaaaggcaatccgggaagactaaggagacaagcgtcaactggtgtctggctgatggctatgacctggagatcctggacggtaccagaggcactgtg

SEQ ID NO: 1560 - DNA, 32 bp, Homo sapiens
tcccaatggaacacccatgacgactcatgagg

SEQ ID NO: 1561 - DNA, 63 bp, Homo sapiens
acaccacctgtcatgctgcgtcctcctcctactcgggtatctgacagtttccacgacacgtga

SEQ ID NO: 1562 - DNA, 218 bp, Homo sapiens
gggccacctgtccatgctgaagaattgctgctgagaggcactgcttaccactctttctatctcccttagagaggcctttaatctcccaaaagactggctaggcagctctttgggtcaaaaaaacattccaggtcgttagggaatagcatagattatttaatccctgtggattaaagccccactgaaatcaaagcctgagcttttccactgtgaaggtg

SEQ ID NO: 1563 - DNA, 326 bp, Homo sapiens
catcattctaaggtgcggtccaggaagctgttttttgtttgtttgtttgtttgtttgtttgttttggagcccttcagtgattcatacaaacaagccaaggagagaacacatggacgacagcattgattcactggaaagcaaagtacagcttccaccataaaaccctgcagctgaaaaaggacaaactgagcagctctcaaataaagacagcctcagccgtcttgcacagcacggcccctctccgtgcccgagtcctgtgcctgtatgaaagcactaaatcacagaccccgcaacctgttataagccctggtaacaatcagcagctg

SEQ ID NO: 1564 - DNA, 195 bp, Homo sapiens
aaggtttctggctctaatcagcccatcacaaaaatgagatgagtatttccctgttgtcataaccccttagggtgaggagtgtatccttggtgacagaccaaaatcaaatcatttttacaaatatttatggagtatggtttgagaggatgaagaagaaaagcatgtggaaacatggggcaaattgggactttttat

SEQ ID NO: 1565 - DNA, 120 bp, Homo sapiens
agagtgtcgatactaggcaacaagcctctgaacagatagtgttacccggaacatcacccttttctccctttgcttcaaatcaaaaccagcatcccccatttagacagcataaaaggtatg

SEQ ID NO: 1566 - DNA, 69 bp, Homo sapiens
gaatccctagatccaactttctttggtgagtttgcaggggtttctgatggttctcttgtttcacgggtt

SEQ ID NO: 1567 - DNA, 89 bp, Homo sapiens
actccacgtacccttatccttcatcctccaacagaaccaagcaatgcgtggtgccctgtactcccagcttggtgcatagctccatccct

SEQ ID NO: 1568 - DNA, 72 bp, Homo sapiens
agggagaaacggtgcgattcacatattccgcgagatcatcaagccagcagagaaatccctccatgaaaagtt

SEQ ID NO: 1569 - DNA, 212 bp, Homo sapiens
tggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatc

SEQ ID NO: 1570 - DNA, 323 bp, Homo sapiens
tgaaagggatagtcaccttgggttgggttggaggggatggtcacgttgggttggaagggacggtcatctttggatggaagggatggacaccttgggatggagtaagtggtcaccttgggatggaagagatggtcatcttgggatggaagagatggtcatctagggatggaagggatggtcatctttggatggaagggatggtcacttttggatggaagggatggtcatttttggatggaagggatggtcatcttgggatggaagggacggtcaccttgggatggaagagatggtcatcttgggatggaatggctggtcacctt

SEQ ID NO: 1571 - DNA, 69 bp, Homo sapiens
ctcgtacccaaaacctgcctgatgggcagctggacggcagcatcaatgaggagcaacccgccagggatg

SEQ ID NO: 1572 - DNA, 92 bp, Homo sapiens
ctggcccacaaggttcacctggcttacctggagacaaaggtgcaaaaggagagaaagggcaggcaggcccacctggcataggcatcccaggg

SEQ ID NO: 1573 - DNA, 35 bp, Homo sapiens
tgattgagaaggaatgcagcgcgctcggaggcctc

SEQ ID NO: 1574 - DNA, 74 bp, Homo sapiens
tgccggtacttcacggacatcatcaagtgccgcgtgatcaacacatcccacctgagcatccacaagacgtggga

SEQ ID NO: 1575 - DNA, 31 bp, Homo sapiens
ggaggaggtggtagcggactgactgagtggg

SEQ ID NO: 1576 - DNA, 273 bp, Homo sapiens
tagctagaccctgtgattgcccgtggctctctgagtctgtcttattgagtagttagcagtattttttcctaaaattcagaagtcatctttgttacacaacacaggggttcaggtagcaataggacacaaaattgctttattctacaactgccagctccaggcagaaataggaaggcaaagagataagagaaggaaaaatgagagaatgaagtctgtatagggtagagcaatagaaagtaagcttcgggtgcctccaacgttcatggctgcctg

SEQ ID NO: 1577 - DNA, 57 bp, Homo sapiens
gaagtggaaaacgaagacggcgacagcagctgcggggatgtatgcttcatggacaaa

SEQ ID NO: 1578 - DNA, 33 bp, Homo sapiens
agctctcaggttcgtgggaaagctaacatacaa

SEQ ID NO: 1579 - DNA, 68 bp, Homo sapiens
tgtcttggtactgctcccctgtttcatcattgtcggtttcttcatccggactctactcctggaagggg

SEQ ID NO: 1580 - DNA, 231 bp, Homo sapiens
tggggagctaccgaaatccattttaccgctttacgttccccatgccataaaggtgcatcagtgagacagctttggggatagaaatgaaagggcttctttatgtgtgggggaaagcatgggaccttgagggcagtcagaagcacagaagggctggataactatgggaaatgactggtcgctccttgtatcctagataggggaaaacggttggctgttccttagaccctaagc

SEQ ID NO: 1581 - DNA, 81 bp, Homo sapiens
tgactctggtaatgatctggcactggaagaccatgaagatgatgatgaagaagaactcctgaagcgatctgagaagttgaa

SEQ ID NO: 1582 - DNA, 165 bp, Homo sapiens
tagtccgcattatttaactgactggttctaaggataagttctgatttcaaaggatacaaataaatagagctagaagttctatttttgcccttgcaattctggtcagaaaactatggagaggatagccacataaagaattcttgcagcacagccacgaaaggtttc

SEQ ID NO: 1583 - DNA, 30 bp, Homo sapiens
cccacagggtgtccatgggaagctgggata

SEQ ID NO: 1584 - DNA, 78 bp, Homo sapiens
ataatgttggtgactctgtgaaggatattagaggaggcaagaagaccattgatgaggttcctgcaataggtcatttga

SEQ ID NO: 1585 - DNA, 34 bp, Homo sapiens
tggcatatgctgtagtgatcatgtcctggacctc

SEQ ID NO: 1586 - DNA, 67 bp, Homo sapiens
caaaacaacagcgagtgcaagaggacacagcaaattagagaatgcatgcccctatctaacagatgcg

SEQ ID NO: 1587 - DNA, 106 bp, Homo sapiens
ctgcgcagtccagcctttctcctgttgggtgatgctgctaagcatgctcccaggatagaggaagcatctgccatgcttgtgggtagacatgggttactaagtaaca

SEQ ID NO: 1588 - DNA, 213 bp, Homo sapiens
gtgccaggccattcgcaccagccaccacccactcccaccccctgtagtgctcccacccctggactggtggcccccaccctgcgggaggcctccccatgtgcctgcgccaagagacagacagagaaggctgcaggagtcctttgttgctcagcagggcgctctgccctccctccttccttcttgcttctaatagccctggtacatggtacacac

SEQ ID NO: 1589 - DNA, 305 bp, Homo sapiens
catcccgaccctcttgttatactttacatcccgaggcagcgcaggtccgagcccgacccgcacaagcctgcgacgtaccctgtcctcgccaccccacccctcggtttggtttcggccgggcagccgcgagaaggcggggaggcgcggacagccgcaaacttccccttcttcgcgcaagcttcgcagacgtgtccgggtcgtttgctcttaaaggggccggcgctctacctggcgaagccacccagccctggtagtggagaggcttgggactagaggatgagattcggcctcatactccgcgctgt

SEQ ID NO: 1590 - DNA, 632 bp, Homo sapiens
cctcattttgtccactggtgaattcaactggaagctccttctatagtctgaagaataccatctgaaagaactagtggttcccaatccccacatttaaaatggaatgtttggtttatttaaagtaaataggctattttttcttactgggtctggcttctctggcccttcgcatacgtgtgtctgctgagtgttcctgcatgtaagaattaagaccaagggaggggagagagaaacccacacataaacaatgcactaaagatcactgaactgtttaaacatttccacttgccagtttaatttcttgaagactgttgcttgtttggaatgtttcttgtcactgattttaaggttgcatctggaaaagactaaaggcttcagtcccctcccaccaccagaaatgaacaaaaagcattttacctaaaaatacaccagcaaaatgtactcagcttcaatcacaaatacgactgcttaaaactgcagaaatttcctcaacactcagcctttatcactcagctggattttttccttcaacaatcactactccaagcattggggaacacaacttttaatcatactccagtcgtttcacaatgcattctaatagcagcgggatcagaacagtactgcattta

SEQ ID NO: 1591 - DNA, 35 bp, Homo sapiens
ttgtgcgccgggtggagattctcagtgaaggaaat

SEQ ID NO: 1592 - DNA, 293 bp, Homo sapiens
agtcccgctgggccctagaccaagacacgggagaacctgtgacccaccgccccctggttagggcacagaggatccacaccttgccgtgccctggactacagcacggagggaccccgatctgccgggcactgggctcctgcacagaggagcccctgccatggaggtctggactgtccttgccccaccgcaccctggactactgcacgccaagaccctcgcctgaacgcgccctacactctggcatgggagaaccctgccccgcagagccctggactccgccactggaggactcg

SEQ ID NO: 1593 - DNA, 1053 bp, Homo sapiens
atatgccaataattcctggcaaagatttcatgacaaagacacttaaagcaattgcaacaaaagtgaaaattggcaaatgagacctaattaaatcttctgcacagcaaaagaaactatcaacagggtaaacacacaacctacggaatgggagaaaatatttgcaaactatgcatacagcaaagatctaatattcagaatccattaggaacttaaacagattaacaagcaaaaaaaacaagcaaccccattaaaaagtgggcaaaggacatgaacaaacacttttcaaaagaagatatacacatggccaacaaggatatgaaaaaatacctgatatcactaatcattagagaaatgcaaatcaaaaaaatgccatcacactaatcagaatggctgttattaaaatgccaaaaaattacagatgctggcgaggttgcagagaaaggggaatgcttatacactgctagtgggaaaataaattagttcagccattgtggaaagcagttgggtgatttctaaaagaacttaaaacagctaccattcaagccagcaatctcatgactgggtatatgtccaaaggaatataaattgttctaccataaagacatgcacatatatgttcactgcagcactattcacaatagcaaaacatgaaatcaacctaaatgcccatcaatggtagactggataaagaaaatgtgacacatatacaccatagcatactacacagccataaaaaagtacaagatcatgtgctttgcagcaacatggatggaactgaaggtcattatcctaagcgaactaatgcaggaacagaaagccaagtaccacatgttctctcataagtggaagctaaatattgagtacacatggacacaaagaagaaaacaacagatatggggcctacttgagggtggagggtgggaggagggtgaagactgaaaaactgcctatggggtactatgcttattacctgggtgatgaaataatctgaacacaaaaccctggtgacatgcagtttacctatataacaaaactgcacatggactcttaaac

SEQ ID NO: 1594 - DNA, 2099 bp, Homo sapiens
ctgggctctctcagaaacttcaggagatgttagaacaagtctttccagttagagaagaggagtggtgataaagcccactgaccttcacacattctaaaaattggttggcaatgccagtataccaacaatcatgatcagctgaaagaaacagatattttaaattgccagaaaacaaatgatgaggcaactacagtcagatttatagccagccatctatcacctctagaaggttccagagacagtgaaactgcaagatgctctcaacaggattatgtctcatggagaccagtaagaaaatcatttatctgaaggtgaaatgcagagttggataagaaatacattgctgggtttctaaaatgctgccttcctgcctctactccacctccatccctggactttggacccttggcctaggagcctaaggaccttcacccctgtgcaccacccaagaaagaggaaaactttgcctacaactttggaaatgctggggtccctggtgtggtaagaaactcaacatcagacgggtatgcagaaggatgttcttctgggatttgcaggtacataaaaaatgtatggcatcttttccttgcaaattcttccagtttccaagtgagaaggggagcaggtgtttactgatggaaaaggtatgttgctatgttgatgtgtaagtgaaatcagttgtgtgcaatagacaggggcgtattcatgggagcatcagccagtttctaaaacccacaggccatcagcagctagaggtggctggctttggccagacatggaccctaaatcaacagacaatggcattgtcgaagagcaacctgttaatgaatcatgttaaaaatcaaggtttggcttcagtttaaatcacttgaggtatgaagtttatcctgttttccagagataaacataagttgatcttcccaaaataccatcattaggacctatcacacaatatcactagttttttttgtttgtttgttttttgttttttttcttggtaaagccatgcaccacagacttctgggcagagctgagagacaatggtcctgacataataaggatctttgattaacccccataaggcatgtgtgtgtatacaaatatacttctctttggcttttcgacatagaacctcagctgttaaccaaggggaaatacatcagatctgcaacacagaaatgctctgcctgaaatttccaccatgcctaggactcaccccatttatccaggtctttctggatctgtttaatcaataagccctataatcacttgctaaacactgggcttcatcacccagggataaaaacagagatcattgtcttggacctcctgcatcagcctattcaaaattatctctctctctagctttccacaaatcctaaaattcctgtcccaagccacccaaattctcagatcttttctggaacaaggcagaatataaaataaatatacatttagtggcttgggctatggtctccaaagatccttcaaaaatacatcaagccagcttcattcactcactttacttagaacagagatataagggcctgggatgcatttattttatcaataccaatttttgtggccatggcagacattgctaatcaatcacagcactatttcctattaagcccactgatttcttcacaatccttctcaaattacaattccaaagagccgccactcaacagtcagatgaacccaacagtcagatgagagaaatgaaccctacttgctatctctatcttagaaagcaaaaacaaacaggagtttccagggagaatgggaaagccagggggcataaaaggtacagtcaggggaaaatagatctaggcagagtgccttagtcagggaccacgggcgctgaatctgcagtgccaacaccaaactgacacatctccaggtgtacctccaaccctagccttctcccacagctgcctacaacagagtctcccagccttctcagagagctaaaaccagaaatttccagactcatgaaagcaaccccccagcctctccccaaccctgccgcattgtctaatttttagaacactaggcttcttctttcatgtagttcctcataagcaggggccagaata

SEQ ID NO: 1595 - DNA, 111 bp, Homo sapiens
tgccgaagtttacctccactagttctttgtagcagagtacataactacataatgccaactctggaatcaaatttccttgtttgaatcctgggaccctattgcattaaagta

SEQ ID NO: 1596 - DNA, 629 bp, Homo sapiens
gggtcgccatgaatccactttggttttaaaaccattcccgaatgtcctagtggattgtgttgtgctgcctaagctgccggctgcaggagccagagaagtgacccccgcgggagcagcggcaggtggatctccacggtggctcgctttgtttttgttttgttttttcttttaagacggagtctcactctgtcgccgagtttggagtgtattggcgcgatctcggctcactgtaacctccgcctcctgaattcaagtgattctcctgcctcagcctccctagtagctgggattataggcgccccccaccacgcccaagtaacttttgtatttttagtagagatggggttttgccttgttggccaggctggtcttgaactcccagcctgaaatgatccacccacgtccacctaccaaagtgctggaattgcaggcatgagccaccactcccggcctgctttttgtttttgaagacaggacttaggtctcctcctcccgaactctaaacctgcgtgtgtggctgtgcaccgctcgtttgtagcgtcacctcaggtctggggaagtctgtgctggcatctcctcattgtgccttcatcagagctggtgccttcgggccagaaagactctcgttc

SEQ ID NO: 1597 - DNA, 78 bp, Homo sapiens
agctgcttcctgtcaaggcgccccaactcgctttccaccccccttctcagagctgctttctacaagcatgtagttaac

SEQ ID NO: 1598 - DNA, 422 bp, Homo sapiens
tggcttcaaatgctatctgtgtgtggatagctcctccagtccacacctcttttctgaatcttttttcaaattcacacatgtgaatttgaattccaggctcatcacatccaggtgtgttccccacacctccacctgaatgtctattagaaatctcacacccctcttgtccaaaactgagctcttgatctttaaccagaaactttatctcagctattggcaactccaggtttctgttttgctcaggccacagacttcagagtcattctcacactgccttttctctcatacaccattatgtacctgtcagcaggtcccaaatatctagaatttgattgcttcacatccctatagcaactctcctggttcaagcccatcatcatctggatttttgggaagtggtcttaactggtgtgctgcccttc

SEQ ID NO: 1599 - DNA, 129 bp, Homo sapiens
aaggcaatggagagtttggctcctgcaaagtaaaggaaactaaaagggctcacagtgggacagggatcaggagccaggttcatagcttgaaaccaggcactatagtgagattcccgtgttcatgaagga

SEQ ID NO: 1600 - DNA, 271 bp, Homo sapiens
ccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttg

SEQ ID NO: 1601 - DNA, 333 bp, Homo sapiens
ctccctccttcagtcatagtagttccactttatctgtttcatatcttgagttctacctaaaattttacttcgtaaaaaagactctgctggtaaaagatataaaaatcatatggtcaagatggtgattccacctcggtgtaatcccagccaacttgggaggctgaggctgaaggatcacttgaacccaggagtttgagtccagcctgagcaacataacgagacttctgtctctaaaagaaaaaagagtaaaaatctcttgtttttattcagctacttgtgcagttaaagaaaacccaggaacacacaatccgtttttgggagatgtattcagcc

SEQ ID NO: 1602 - DNA, 221 bp, Homo sapiens
tctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttt

SEQ ID NO: 1603 - DNA, 57 bp, Homo sapiens
tgatcccccaggagtcccctcgagtgggtggatttggatttgttgccactccttccc

SEQ ID NO: 1604 - DNA, 329 bp, Homo sapiens
ctctgagggttgagaaacatttcccaactatcctgtacaattctctacatgtgaattatcatgtaatccctttgaactacatatcatgcacagaatttatgatttcaagttctatcctgtgctatttaatttctaagctgaacacatatttaacagaaggcaagaaagaagatgaaatgtggttcacacatttttcatcataatccatttatataagataacttggaaaagaatctgtaagtcatttttattagtctgtcaaagaaatggctgctaataaaactgccgaatcaaatcattaccagtactgtgcattgacccttggcata

SEQ ID NO: 1605 - DNA, 30 bp, Homo sapiens
atattaggctcaattagagaaacaataaag

SEQ ID NO: 1606 - DNA, 88 bp, Homo sapiens
agcaagcccctctgttcagggaaacccaatgtccttcaggctctccctgcttctccttaccacgcccactgttgtggttgtgctggct

SEQ ID NO: 1607 - DNA, 128 bp, Homo sapiens
taccatcatatatcacgcatttccccctcctggaatatgtgcaaaaacaagcctttcttcaacaggaaaatggtgctggtgtaggacatctactcacggcatccaggaagtagatctagcagcccaga

SEQ ID NO: 1608 - DNA, 77 bp, Homo sapiens
aaggccagcacagcgtggtaaagcatcagatctctggctctgcatgccccgccgctgagcctcagcccaagcacact

SEQ ID NO: 1609 - DNA, 688 bp, Homo sapiens
tgggcaccgttttgcaggaaacaccatattaatagacatcctcaccatctccatccgctctcacgcctcctgcaggatctgggagtgagggtggagagtctttcctcacgctccagcacagtggccaggaaaagaaatactgaatttgccccagccaacaggacgttcttgcacaacttcaagaaaagcagctcagctcaggatgagtcttcctgcctgaaactgagagagtgaagaaccataaaacgctatgcagaaggaacattatggagagaaagggtactgaggcactctagaatctgccacattcattttcaaatgcaaatgcagaagacttaccttagttcaaggggaggggacaaagaccccacagcccaacagcaggactgtagaggtcactctgactccatcaaactttttattgtggccatcttaggaaaatacattctgcccctgaatgattctgtctagaaaagctctggagtattgatcactactggaaaaacacttaaggagctaaacttaccttcggggattattagctgataaggttcacagtttctctcacccaggtgtaactggattttttctggggcctcaatccagtcttgataacagcgaggaaagaggtattgaagaaacaggggtgggtttgaagtactattttcccagggtggcttcaatctcc

SEQ ID NO: 1610 - DNA, 81 bp, Homo sapiens
taccaagagccacaaaaccaccactcacaggacaaccaccacaggcaccaccagccacggacccacgactgccactcacaa

SEQ ID NO: 1611 - DNA, 87 bp, Homo sapiens
tctggtaaggctagaaggtcatgcgagaaactgtatgaagagacacagagtaaggatgggcatgagagatgaacacgaacaagtgtg

SEQ ID NO: 1612 - DNA, 180 bp, Homo sapiens
tctgatgctagagaacgagaaccgcagtgcgtgcccgacacaaagggaaggacaggggacactggaacaggggagacgacatggaagaaatctgggggagccaaaagccgccatgccgagaagggggtcggaggaggcgcgggagagaaaagcccagggctgtacactcgcatccctctg

SEQ ID NO: 1613 - DNA, 34 bp, Homo sapiens
gcccacaccagggaccatgtttcatcctcctaaa

SEQ ID NO: 1614 - DNA, 385 bp, Homo sapiens
cttcagggcagagatgttgcttgttttccccaccattttgtgtcttcagcacccaaatactaaatgagcattctaggcagaggccagtatttgtaaaggctaggatgtgtgaaacgatatggtctggtgggagcagagtatcagtcagtaaactggtgggcattgaagctgggcacatcagcagaggcaaggcttgagattgtgagaagccattgctcctgtggttctccctcatcccctacactcatcatgacttgaatgtaccaaggtgtgcaaggatgcatccaagacccttgggtgaggggaaaacatggagctgggggtctggatgcctgggccttcctaggacacctagtccccttccatctgcaccttggggtctgtc

SEQ ID NO: 1615 - DNA, 233 bp, Homo sapiens
gcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagc

SEQ ID NO: 1616 - DNA, 34 bp, Homo sapiens
cttgagaaggttactgagtgagttattgggagtc

SEQ ID NO: 1617 - DNA, 107 bp, Homo sapiens
agcagccaacttggacccgcaagtgggaccaagtatggagcatggcagggcttgcttccaggatccctgaatgacactgtggggcaaagctaccgaccctccatgga

SEQ ID NO: 1618 - DNA, 543 bp, Homo sapiens
acgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatg

SEQ ID NO: 1619 - DNA, 157 bp, Homo sapiens
cgcattcccggttgtttgcagaaaatttacagctgagtaataaaagtttacgatcgactcacaagttggattggccacaagaagtcatgtggattccatccatgaacgtgaactttttattgtggtttgtccgttccgagcgctccgcagaacagtc

SEQ ID NO: 1620 - DNA, 59 bp, Homo sapiens
tctgcctcagagactccctgattggccccttttctgagaggatgtgctatctctgcagt

SEQ ID NO: 1621 - DNA, 31 bp, Homo sapiens
aggaatgttacacggctgctggtgttttcca

SEQ ID NO: 1622 - DNA, 52 bp, Homo sapiens
attggacttcaaggagaaattaaggagggtggtcgaatgtagatcaaattaa

SEQ ID NO: 1623 - DNA, 142 bp, Homo sapiens
tctatctcagctgccgactacagggccccctgctgtttccagttcctggcccacccagagtttttcctactcatgtgggctacccccaggacactgggagcgaggcccttgtttaaggaatcgtcttcagcatcacggcaga

SEQ ID NO: 1624 - DNA, 39 bp, Homo sapiens
cgcgtgaagcgggagaagcgcgatgacggctacgaggcc

SEQ ID NO: 1625 - DNA, 318 bp, Homo sapiens
tggtcagtcgcttccaccaaccgtttccttttgcagatactgcctgggtctgaacctgattaaagttctacattataggcttcctactccaaatcctaatgtttattctaactagtatcagtctgtttcagtcaaaatacaaactataacaatgaacacgctattttagaaatgtagccaaaatccttacttatgatctatgattatgtttcttttaaattttaaatgtattcctaggagtgaacgaaagcgtttcttcatagtgttttatggtcaccattagagcccaaatcctgctttccctatagcaactgggtg

SEQ ID NO: 1626 - DNA, 375 bp, Homo sapiens
ggcatcccagtcttcggtctccaaatccacctcctgtctgtccccccacactgctcctcaggccttgtggatccattgactgtgatttctgtggttcagctcccacatcaggcaggaagggcagctactgggtctgagatcccacattgcctccaacccttgcttcctagctggcctcccagggcaccacgaggggctgggccaggctgctgtgctgcacgtggcaggagtagggggctgtgtcctgcgggggcactgccaccaccacccaggactggtaagtgccatttccattgtgaagaacatctccccgtaactcaggctcctgcacctcgccggcccgagtccagtgcacatcaattttccctgggtaga

SEQ ID NO: 1627 - DNA, 462 bp, Homo sapiens
gaagcctcaagttccagtgcagagatcctacttctctgagtcagctgaccccctccccccaatccctcaaaccttgaggagaagtggggaccccacccctcatcaggagttccagtgctgcatgcgattatctacccacgtccacgcggccacctcaccctctccgcacacctctggctgtctttttgtactttttgttccagagctgcttctgtctggtttatttaggttttatccttccttttctttgagagttcgtgaagagggaagccaggattggggacctgatggagagtgagagcatgtgaggggtagtgggatggtggggtaccagccactggaggggtcatccttgcccatcgggaccagaaacctgggagagacttggatgaggagtggttgggctgtgcctgggcctagcacggacatggtctgtcctgacagcactcctcggcaggcatg

SEQ ID NO: 1628 - DNA, 42 bp, Homo sapiens
actggattctctctcaagctccgtccgcaagcaggccatgga

SEQ ID NO: 1629 - DNA, 136 bp, Homo sapiens
ataggagacctcattcctacaaataataaaaaaaattagccagctctggtggcgtgtgcttattggtctcagctacttgggaggctgaggtgggaggactgcttgagcccagaagatcgcagctgcattgagccat

SEQ ID NO: 1630 - DNA, 543 bp, Homo sapiens
ttggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttc

SEQ ID NO: 1631 - DNA, 30 bp, Homo sapiens
atggcgcttctggccctcaatcagccaggg

SEQ ID NO: 1632 - DNA, 40 bp, Homo sapiens
ttatttgccatacagtaaccagagacctccaactaggggc

SEQ ID NO: 1633 - DNA, 75 bp, Homo sapiens
ggtagctgatttccgcctgcaaatagctctcccccaggccactgctgcagcctttcatggagtagaccccttcta

SEQ ID NO: 1634 - DNA, 167 bp, Homo sapiens
cagatctcagctgccgagtggaaaccccattctcacaccatagctatgggactgggggaaaggggaggaaataactaaagagtaaggaattgggggaggctttgaggtttggatgtgacaggtagtttgcatgtagttggaatgcagtaacattggtccacaaggtt

SEQ ID NO: 1635 - DNA, 31 bp, Homo sapiens
gacagatatttgcatcgggatgacatctgtg

SEQ ID NO: 1636 - DNA, 214 bp, Homo sapiens
aagaagcaacaccattcagttcagaacacccatactgactttgagctgatggcctttgtaggtttctaactggaagtgaaattttttctatttttaaaactttctttttatttcatagttactttttaagctttttttgttaaaaattaagacacaaacacacaccttatcctaggcctatacagggtcaggatcatcagtatccgtcttctgc

SEQ ID NO: 1637 - DNA, 125 bp, Homo sapiens
ccgctcccaaatcccggctcggtcgcccagtcactggtacagggaagcctcttccctgtgcattcctctctgcgccaggctctgcccgctcccacctgcccccgtggaaatcgcagggtgacctg

SEQ ID NO: 1638 - DNA, 269 bp, Homo sapiens
caggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagg

SEQ ID NO: 1639 - DNA, 156 bp, Homo sapiens
gacccgtgtccttgcagagctcatttctggagaagaaagatctggttgcatagagtgccctgtgatgagggctgtaatggaaggggcagagagttccatggaaaactggagagaggaggcagaaactgctgcaatatctgggcttgagcttcacag

SEQ ID NO: 1640 - DNA, 98 bp, Homo sapiens
caaatgttttgctgacgttacttcatttcatccggctaaatggataaccccattttttgggtgagggtcatgactaaagttgcatagcttgcaggtgg

SEQ ID NO: 1641 - DNA, 32 bp, Homo sapiens
gagacatcgtcgcaaagttatgtggaggaaca

SEQ ID NO: 1642 - DNA, 123 bp, Homo sapiens
cgcgggtttgtaaatagagtccctgtatctgcaggtttaactggtcagtctttgacaggcttttaagcaaggacatttcaatgatgtgaggaaaaaaaaaagtgccacaaagctttgagaatc

SEQ ID NO: 1643 - DNA, 57 bp, Homo sapiens
atctgtgggagctaatcctgtccaggtggaagtaggagaatttgatgatggtgcaga

SEQ ID NO: 1644 - DNA, 65 bp, Homo sapiens
gttgcactacgcgaatggcctttgctgacgtcttctgaaacaggattagatatagccatgcagct

SEQ ID NO: 1645 - DNA, 500 bp, Homo sapiens
tccagcctactgttgatggcagctaggttgattccatgtttttgctattgtgaatagtgctgcagtgaatataccagtgcatgtaccttttttgtagaaagatttatttttctttgggtatagaaccagtaatggaattgctgggccaaacgggtagttctggttttttatttatttatttttatctgtctgtctatgtatctatctgtctattgagacagagtttcactcttatcaccgaggctggagtgcagtggtgtgatctcagctcactgcaaactccatgtcctaggctcagacgatcctcccaagtagctgggaccacaggtacatgccaccatgctggctaatttttgtattttttttttgtagagatggggttttgccttgttgcccaggctggtcttgaattcttggctcaggtgatccgccctcgtaggccccccaaaatgctgggattgtaagtgtgagccactgggcctggcttagttctattttta

SEQ ID NO: 1646 - DNA, 176 bp, Homo sapiens
ctgccttcgcagacaggaatgctgtccttccagcttctcctacccttcgggtcagagcccaaaggtccccacccctggttagggctgttttcactgggcggggggcgggggactacactccttggtaactgtcacaactgcccttaactaatgatttgtgcattgccacctgaggc

SEQ ID NO: 1647 - DNA, 738 bp, Homo sapiens
gttggtctcgcttcctatctcactaagagaaaataaaagcagtcagaagagaactcccagtctcccattgcctcacatatcctcccccctgcatctgtgcctgatgttctgcttcttcctgctgtgagtgaaccatccacactcttagggagaccaagccttccatttgtgcgctgcattccattttctttggcctactgaaggacatccatctctgctagatgtttcgtatcagcatataaacatgccacaactgcatttctctcttcccagtctctctctctctctctcttttgttttgggtttttttgttttgttgtttttttgttttttttgtttttggttttgagaatgagtctcactgagtcactcaggctggaatgcagtggcgtgacctcggctcactgcaacctcctcctcccgggttcaagtgattctcccacctcaacctctcaagtagctgggattacaggtgcatgccaccacacccagcttatttttatatttttaatagagacagggtttcacaatgttggccgggctggtctcgaactcctaaattcaagtgatctgccccaccttggcctcccaaagtgcggggattacaggcatgagccactgtgcccagcctatcttgaacccactccctcaaaacagctcttgccaaaggtaccagtgaccttcatgttgctgagtccgctaacctctcagcttttggcacagctgttgactcctttc

SEQ ID NO: 1648 - DNA, 186 bp, Homo sapiens
gagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcaga

SEQ ID NO: 1649 - DNA, 118 bp, Homo sapiens
actgccaccgtgatgccatcagatgggagaaaacacagaactcgggatgaaacgtcacacggtctgggctaaagatcttgctctttaatttcccagcaggtaaccttgtggcagtcac

SEQ ID NO: 1650 - DNA, 1348 bp, Homo sapiens
agcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttg

SEQ ID NO: 1651 - DNA, 60 bp, Homo sapiens
gactcgattaccaatcctgccctacatcagaagactgtgaaaataatcctgtggattcct

SEQ ID NO: 1652 - DNA, 61 bp, Homo sapiens
aatctcagttgccaaacctgtgtcggccacattaaagcaacagttactatatcagtcatgg

SEQ ID NO: 1653 - DNA, 125 bp, Homo sapiens
aatgctttgtctgccttatttgtcaatgagctccaccctgaactcaataatctggttaaaagcaaaagctaaattggaaagttcctaactaaattagtaaactcaacacttcaggatctttgtta

SEQ ID NO: 1654 - DNA, 100 bp, Homo sapiens
cttgggctgacgacaaagttgtacatcctgaaccccaaagccgtgagtgtcatagaactctacggcatcctggacccaaccacccgagactggacagatg

SEQ ID NO: 1655 - DNA, 900 bp, Homo sapiens
atacaacatccacgagggtccctgcagctgtgtcactgaggcaaacaggaaaagtgattttggctaggcgtggttctcatctgtgaaattccacagcgcaatgacagcagcctctctcccacccactcaagacactgtcaggaatgtcttaagacctcaggagaccacttctttagcaagcaattttgttttttgttttttttgagatggattctcactctgtcactcaggctggagtgcagtggcgcgatctccgctcactacaacctccgtttcctgggttcaagcgataatctcacctcagcctcttgagtagctgatactacaggcatgcgccaccacgcccggctaattcttgtatttttagtagagacagggtttcatcaggctggtctcaaactcctgacctcaggtgatccgcccacctcagcctcctgaagtgctgggattacaggcgtgagccaccttgcctgccctggcaaggaatacatttttaaaaattagtaagaaacatacacatttcaagttttcaattaagaataatatttgctgatggcaccatcttcctgtctttcagccttcagcatggtagaggaaaagagaaagagtgtagacaaaaacagttgaagaacatctgtgcttgttccaccttcattttctgttttgtgcgttgcctgaatgaacggtgtcttcaggttggtatttcacaggcggtgctcccaagtagtctggttttcccatttgtggagggcgaggtcatagaggggacagggggaggctgtctggtcagcactgtgtatttccaaagaacaaggactagccaaaactacaagcctttgaaggaccaaaggaaaagagaaaaaaccagcctctaaccaggccatgcgctagaaatgattg

SEQ ID NO: 1656 - DNA, 43 bp, Homo sapiens
atgactggagtaagaagagtgaagattccctcgatgccacacc

SEQ ID NO: 1657 - DNA, 75 bp, Homo sapiens
gcgcggagcccgaaccctgtacgtgtggccccgccgggccggtcgctgcgagcctcgccccggtctcggccaccg

SEQ ID NO: 1658 - DNA, 83 bp, Homo sapiens
cgcatcagcgagttagagaggaatgtggaagaacttaagcggaaagctgcccaaaactccggggaggcagaatatattgaaaa

SEQ ID NO: 1659 - DNA, 201 bp, Homo sapiens
cacagattctgacagggtccagctaggaaggtaagtgagaatgcagacatgaggcctatgaaggggtggctgtggtgaacatgagtgagagactgaggcctctttcacagggtctggctcacctgaccacccgctactgacccccagctgagcagggccaggtgggtataggaccagagtgactccatctttagtcttccg

SEQ ID NO: 1660 - DNA, 36 bp, Homo sapiens
tcagttggaaggtgtaaatgtggaacgttacaaaca

SEQ ID NO: 1661 - DNA, 584 bp, Homo sapiens
gcacacatcacagcttttaacgttagttaataaaggttaaacacacaacatacatccttacaaaaaaagtcaaaatgcaaacttaaaactttaaacaaaagtattactaatttaaaaaaagtttgtgttgggtaccatttgtacaacacagttaatttaaacattttcattttggttgcacatgaaaaaggcggcagtagaaaataaagtcattgagggtttttaaatagcagaataggcagttttgccatgcaggagaagcaatattaaatattagtttcaaaaaaaatccacatttaaaaatatttagttcaagtcacagaatttttctcagtagagaccccaatgcaatgcataattagctgccttagatggcccgtttgaaaggatgatatcccttcagagtgtaactttactgattttggcacagaaaagaagtcttaagaacatgattaaaaaagagggaagaggaacagaggaaagaaataaaagcaagaataaatgagatagtaattgcaatcactaaaaaactgcattctcagtcattgcagaatactgtcttctgtctacagcaggtgcttatt

SEQ ID NO: 1662 - DNA, 48 bp, Homo sapiens
tgcatggatctattagtggatgggcgccagaacgacacagtcaatgca

SEQ ID NO: 1663 - DNA, 171 bp, Homo sapiens
atgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgta

SEQ ID NO: 1664 - DNA, 275 bp, Homo sapiens
ctcaaagtgtggttgctagaacagcagcatcagcatcacctgggaacctgttagaaatgcaaattttcaggtccacccagatctactgggagctctgggcatgaggccagcagtctgggttttacagagccatctaggagattctgatgtatgttagagtttgagaaccctctgacccaaggaagcggtggtgtttcaagagtggaaacctccaaaaagaaaatgaataaacatataatattttcatattgccagcttcctaggcaatctgattt

SEQ ID NO: 1665 - DNA, 34 bp, Homo sapiens
agaagcacagcatcatcctaaggacgcagctgtc

SEQ ID NO: 1666 - DNA, 66 bp, Homo sapiens
ttttgttgtgcctaataaactgctctccactcaatgaatattgttacttgactcccattacaactc

SEQ ID NO: 1667 - DNA, 107 bp, Homo sapiens
ggccaaaagtgtacgttgtcactagtgccttgccctcttacatagccagtagaccacatcttctccaagaacttcctcaaagaggggaatgcaagctacctcaaccc

SEQ ID NO: 1668 - DNA, 93 bp, Homo sapiens
aatatgtgcggggagctgactgtcctctggagtcctccattgatctctgttccttcatcccgtccatggccttgaaagcacttactacaattg

SEQ ID NO: 1669 - DNA, 247 bp, Homo sapiens
ggaggaagcaacaccagccgctttggggaggagctcctagcctaccaagagagatggaaagcatagactgggacccgaatgtcaccaccatcatctcatcttcaccaccatctggcagcttccatgcctcctaagccagtgcgtcccaggcactgggccaggctctgcccaccttatcaccagtcctcctgacagcactgcaagccagctacctttatcaacacacccggttgatagatggctcatg

SEQ ID NO: 1670 - DNA, 169 bp, Homo sapiens
gtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaata

SEQ ID NO: 1671 - DNA, 109 bp, Homo sapiens
attcggatttagcaacatgaaggtcataggtgactcagcggagagggaacaaggttgggagagaatgtggaggtgaggaggaagcggaagcagcaatcacaaagtcttt

SEQ ID NO: 1672 - DNA, 178 bp, Homo sapiens
tgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctg

SEQ ID NO: 1673 - DNA, 624 bp, Homo sapiens
gccgtccatcctcgcattgctgttgaatggtgagcacgtgaccatgccgaccacaaaggtgtctgcggaaactcgaggacattcaccacgatgattttcctctctttgatgtacttcaagtgcaactcaaaactatatctgcagggatgaatctgtaacttaaattgggccaatcagaattgttatctttgttcaggtaaaatgagttgcaagatattgtgggtacttttgtgtgctcatttgtgttttccccccctcctacaacatttttttaaccccaaaattatagcctgaatgttcgcttttagtctggccagggatctgactcctgagttggttgcctctcccctgctcactccagtcacatagagaattggtgtttcccgcagtggggatgcagctgttggacaggtattgggggcaaggttggtagggaggacagactgtcacttgctgttacaggcacaggtgattaaaatgctaaatattgcaaatttaagctttgtcagtatatggaaaagttgaagggaaaatactggaatgcttcttcaaaggttaaaaaataaccgagtcttttggtaatttgaccccacgtgctctctggccctcaagcatgtaacctcg

SEQ ID NO: 1674 - DNA, 79 bp, Homo sapiens
agttagttctgccttcgggccatgactcgctcagcagaaggcactgcccacaagtcaccgttgagaaacccgccctgtg

SEQ ID NO: 1675 - DNA, 65 bp, Homo sapiens
tggatgcggttagagtcacagcctcccttgaagcctggtttcttcctcctaattggactcggcta

SEQ ID NO: 1676 - DNA, 722 bp, Homo sapiens
gctcaggtctcttattgggaatttacatgatgttctggtgtaggcagaggcatttcaaattggtgtaggaattttcaaattaaataggatgtttctctaatttttaaacttaattttgggaatcacttattttagggatattattatacatcatctaatatttcaagcacttgtgaaagtcacattctgctcaacttttctcacatcctttccaagaattttaaatcactttttccatatcatctactttcataaactccctttaatttgaagatgagtcttttctactttgatgcacagtattattgcagtggttatctgttccctgtccgctcatggtccagtttcatcaggattttctgctgaagtcatgatatctgagagagttggcacatactctgaaacgtaggtgcactgtgttaatttaaaagttgtggggaggaaaatcttggggacaagtataaaacaatgagagtgcagaaccaggcattgagaaacatggaaaaaggaagccagaacctgtaaaatacaatatccagggacatggagtgagggaattctcctactgtggatttatagaataaatctcatcttttaaaatggagatgttgtaagatagtttttaagaaagggcacacatctaaactgggaagctggaaggtaataaatactaacacttctgatgtaatttaagtacaggagtctccgctacaccctgtaag

SEQ ID NO: 1677 - DNA, 181 bp, Homo sapiens
acgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtccca

SEQ ID NO: 1678 - DNA, 549 bp, Homo sapiens
gtcaccaggctcacacaatcatttaagaaataaaaacacatacacaaaaatgtaggctgcccctacaatctaatttatgataaaataagatgaatttcagcctaagaatacttcatttattttcttagttgtgaaaaaattagttaagaaccttaaaaagaactttttactctaaccagatcttttaatttcctagaacatactctaatatactagttttcctaagcttgaaacaaatcacagtacagaaaaaaacaataaatggacatgagcgaggattttctccagtaaacagtttaaataatagcctttaactgagggagtggtgaaataacactatcaaaaagttctttacatttagagtgataaacaaagtgcagatttttcacatcttaaactctgagtgaatactaagaataattcttactaatttactagttaaattaattggatagtcactttttagacagtttgccttaaggcccccctcccccaccatacaatacttgcaaccctcaagaaaaagtagaggaggctccaatcaagtca

SEQ ID NO: 1679 - DNA, 221 bp, Homo sapiens
gagccaggaacctcataaggacctagaaatgcccaccaccatcctaatctgtaaaatggatcagccccttcaggcctagaggggtggggtagggggctgggctaggcaggaagaggggacttagagggtgtcactgattcgtgcagcccctcccaccatctgaccaactctcaagggcatggagtcacttattcattcaacaaacatcaggtcagacatgg

SEQ ID NO: 1680 - DNA, 143 bp, Homo sapiens
aaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataa

SEQ ID NO: 1681 - DNA, 125 bp, Homo sapiens
ctcttaggtctaggaagatgtggctgtgtgcggctcctgattttcacccaggtctcactgcagcgcaggacataatgaagaagtatcacacacacatttaaagtaaaacatgatacattcacact

SEQ ID NO: 1682 - DNA, 103 bp, Homo sapiens
tgatccattaagtgagctggggtttgaagttcagaggcgtttggtggaacacgtggacgggctaataagacgctgtggatccatgggaaaaggatgggcacga

SEQ ID NO: 1683 - DNA, 138 bp, Homo sapiens
gctctttcagccgtttggaacagaaatggagcgagcagaagttctaacaggtttaagaactggtcagttgccggaatccctccgtaaaaggtgtccagtgcaagccaagtatatccagcacttaacgagaaggaactc

SEQ ID NO: 1684 - DNA, 149 bp, Homo sapiens
gcaacagtatgttcaatcccatgtgctcttccaaaaaccctaccccctacctcaatcaagagatggcatctatgtcctttccccttgaacccaggtaggcttctcggacgggtttctgtgactgcacctctaaagtaatgctatgttgg

SEQ ID NO: 1685 - DNA, 302 bp, Homo sapiens
aggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtctttt

SEQ ID NO: 1686 - DNA, 38 bp, Homo sapiens
ggaccacgctgctccgtgtgaataaatgcccagtggca

SEQ ID NO: 1687 - DNA, 175 bp, Homo sapiens
atcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctcta

SEQ ID NO: 1688 - DNA, 101 bp, Homo sapiens
gtcccagtttccatggtcagccttacgtcccattaccagttgtttgagtggtctctcccaatgcatcccccataaattatgctaattcctgcctgctcttt

SEQ ID NO: 1689 - DNA, 218 bp, Homo sapiens
ggtgacaacctgcaagtgataagggggtgggtatggtagatacatgagagaagagtacacaaggtttagtgattatgctgtgggaaggggaggaaccagaggtgattctgaagtttggaactgagcgactgagagaatgataaaaatagggaaatcaaaattggaagtcagtagggtatgggatagggtaggtcagtgagtagcgtagttgatggaca

SEQ ID NO: 1690 - DNA, 53 bp, Homo sapiens
gtggggatgcctccatcattccgatgcttgagtttgaagatcagccttgctgt

SEQ ID NO: 1691 - DNA, 144 bp, Homo sapiens
gtaagaagcagtcaattttcacatcaaagacagcatctaagaagttttgttctgtcctggaattattttagtagtgtttcagtaatgttgactgtattttccaacttgttcaaattattaccagtgaatctttgtcagcagttc

SEQ ID NO: 1692 - DNA, 31 bp, Homo sapiens
tgaggggagtatatcggcttctgctgcctcc

SEQ ID NO: 1693 - DNA, 130 bp, Homo sapiens
gcaacagccaccaagaagggttctcatcaccctgttattcagggccagagtttcttcaggagttcaggaagaacgcaacgtatttaaaagagcccgaagactgcaggcatgagcagcaccctaaaaacca

SEQ ID NO: 1694 - DNA, 275 bp, Homo sapiens
ggctgccttgtgaaatgattccctgcagtaaacggacttttcatttatttaatcattcaaacttccattcacatctgcatgattacagaaaacatggggtatgtagactagtaacacataagaaaattgcagtaagatggtaacaaaacctcatattgtctttacatgtttccaatggaaaatgttttgagtgtttattgttcagtttattacgtttcacttgattaaatttttttgttgttgtattaaaccatgtacgttgcagcttaacaata

SEQ ID NO: 1695 - DNA, 131 bp, Homo sapiens
tgaccaatgccctggtgggtatgagcccctcatcctcgctctcagccctgtccagccgcgcggcctccgtgtccagcctccacgagcgcatcttgtttgccccgggcagcgaggaggccattgaaagactg

SEQ ID NO: 1696 - DNA, 238 bp, Homo sapiens
tcagtctgccatacagcaatttttaaatgacataatcctttagaaatcaagcagtgatcagtgctcaacttgaaaagtgatgggggtggggggaacaggcaaaaaaaaaaaaaatcacagaactttagaagatactgtctatcccaacggctctcaaagtttggccctctgaccagcaacgtcagcattacctggaaacttgtaagaaatatacattagtgggcccaccctagacctt

SEQ ID NO: 1697 - DNA, 151 bp, Homo sapiens
gaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcagga

SEQ ID NO: 1698 - DNA, 99 bp, Homo sapiens
ccattatgagagaacgtttgaactgaaaaagtcctctgaactttgttcactaatcttatcaaagaaaatagaagcagaggatgtagacagaaacctgca

SEQ ID NO: 1699 - DNA, 83 bp, Homo sapiens
tggtagacaaggtagacccccaacagaatgtggagccacctgcctccctgaagcataggtcaccaagcctaaaagcagagaag

SEQ ID NO: 1700 - DNA, 367 bp, Homo sapiens
gtcttcatcatggtgggactggctccaggagggatggtggagatatgaagccagatggggcacagggctgtgttctgaggggccttgaggcctcagagagggctttgcactttatccagggatttcagcgggtcgtaagcaggaggggcatctggttggggctctactggaaggctcattgctttggccaggaagatggggaggctggtggcaaagaagcccgttggaggctgttaatgccacccaggccagggaggcagggcccaggtgagccagtgacaggagtgaaggagagagggtgccagggtagagagagctgaaggggcagtggcagcgctgggtagccctgggtagctcagcacatttt

SEQ ID NO: 1701 - DNA, 47 bp, Homo sapiens
gctactcaaggagactcaatacagggacctcagacccactgatcagt

SEQ ID NO: 1702 - DNA, 126 bp, Homo sapiens
gagatcaagggatagcgggtttcccaggaagccctggagagaagggagaaaaaggaagcattgggatcccaggaatgccagggtccccaggccttaaagggtctcccgggagtgttggctatccag

SEQ ID NO: 1703 - DNA, 34 bp, Homo sapiens
cagtgggcattgctgtcggtgctccctttccggg

SEQ ID NO: 1704 - DNA, 338 bp, Homo sapiens
gtagttaagctgctcacgaacatttaaaattttccaaaatgtatcttcaataatcatgatcttataaaacattttacagttatcagaaagtgcccaggctgagtttacataactgaaataccttagtacaaatgtctagttagaactgaagtgcagtaacctcttgagactgactgctcattgaaatagggatacaaagaaaaagttgattgtgataaaagtattgtgcattggccccatcatatgtacaaaaaaagtgccctcactcaaatgagcaaattacatgcaaaatattagtgatatcatttaatatcctagagctcaatgcagtcaaaccg

SEQ ID NO: 1705 - DNA, 170 bp, Homo sapiens
ggcatgtcctcttagacctgctctatggtttttctcttactcagactccttgggtgagggttggagtatttgtggggagagacaactcggcagtgagatgtacgcgctgcttgggctgtggtaaatcctagtaacatggtcttaacactgttggtcaggcattgaattta

SEQ ID NO: 1706 - DNA, 566 bp, Homo sapiens
ttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagt

SEQ ID NO: 1707 - DNA, 119 bp, Homo sapiens
gtcctcatggcgtggtttattacaattccatctcacaaggcgggtgggcgggtggcagcggcacacgaaatccaagcccctgacagacgtctgcctcgggcgcatgcaaacagtgcaac

SEQ ID NO: 1708 - DNA, 34 bp, Homo sapiens
gcaaagtttattgaaggtgttgtgttacagttat

SEQ ID NO: 1709 - DNA, 465 bp, Homo sapiens
ctcactcggtaaaagccaggtcctgacacgggcattcgtggtcccacacgagagcctgcctgctgcttcttcaatcacacctcttaccacccatggccccttgctcactccactcgaaacccggaggtctcctttctgtttctgcctcaggacctttgcactggctgtcttccaacctgaaaggttgcttttgcccttggttcctccaggtcttgactcaaatgtcatcttaccagtaaagtcttttcaccttggcagtttttatccctctttcttgctcagtttttgttttatattacattgcacttaacaccattccatacttaataccaaacaacgtcttctttgtttattatctgtctccccctaaaatgtaagttccatgagatttttttttttcattgctatatccaaaatgcctagagttgttactggaacatagtaggtggtctgtacacatgaacc

SEQ ID NO: 1710 - DNA, 62 bp, Homo sapiens
ctggggattggctttggctagattttctattttaacccatgcttcttcccgttctttcattt

SEQ ID NO: 1711 - DNA, 124 bp, Homo sapiens
agcctccgcttgcaccgtctagagacaggcaggcacctttctgggcagcgtgttccctgtggtgtggccttgttaaaaagcacttgcttattctgagtaagatgacataggtctgccctctgaa

SEQ ID NO: 1712 - DNA, 542 bp, Homo sapiens
gtatacaccactccagagtcaggggtgttcattcttttttgggagtaagaaaaggtggggattaagaagacgtttctggaggcttagggaccaaggctggtctctttcccccctcccaacccccttgatccctttctctgatcaggggaaaggagctgagtgagggaggtagagttggaaagggaaggattccacttgacagagtgggacagactcctccagagtagagcttggagggagattgaaagtggagataatactgctgacacctcccttgaagctgagatgggaaatggacatacttagaaatttagtgactttaatagcctggatttccctctccaaaacttttagaatggaaaatcccatccccttccttatatagtgacttctacccactaccttctaccattttctactttgggcttaggatgatggccattatctacatgtgttttcagcacctggttggttctaaatgggatctggagacccagcttcttggagatttttaagaggaagtattaactggacaaatggaa

SEQ ID NO: 1713 - DNA, 226 bp, Homo sapiens
gtgagtcgtagaccctgttcctacagtttcaacaaaccctgatggtggcatttcagtttatcgtagaggtttcttttcccctacaagggtcattctctcttgcccaattttggctgagaagggaggaatatcatggccgttttggctgtatggtgttactgtataatgatatggggattggtgagtgaaaaataaaatgaaccctcacttgcttaggtaccagttt

SEQ ID NO: 1714 - DNA, 212 bp, Homo sapiens
tgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaa

SEQ ID NO: 1715 - DNA, 2022 bp, Homo sapiens
ctgaggcggtcccacactttggaaaaaaatagtgtgggttcctccctggtcctcccttgccctactgggctcagtttcgcaggggcgggggccggcctctgccctggtctgggggaggggacacccccggaggctgtggcctggtgtcagggcggggcaggggtccccagtcctggcatctgtgttccctgcttgccgggcagtggtgcccctttcgcgaagcacacccgggtggcttggtgctgcacggcctggcacccctacccttccccgaccctggcctagccgggacccagggtccgcgccctccgcccgggggctccccacgtgtgattgatctgggaagcagtcggatggaattaacccacggacaagtgggacggtttgcattgggagtccgccatggacacggcaggtggggccttttgattgtaaaagccctttcggagcccttgcctcgctccaggtgggagctcgcccagcgctagctttggggatctagagccgcctgcctgaggctcccagacagactgcgttttgatcggtcgcacagaaaggtggtgaaacttggggaagattttctagacaggaatcaatgaaaaccattgaggctggagaggagaggttttgagcaactctcttcagtgcggtcagccctgtgtggactgggcagcctgggacctgctcccagtgcagggtcagatgggccgtaaacagggcccggctgtgttccttcctgtgccttgaaaacaagcaggacagcctggcacagaggcagagtctagagctgacaggccttagagagggaaacaggaaagcttctgaaacgtcccgttcacactgatcgttccatttcctcttgtgtctgagtgggagcgggtgtcctccctgcagggaatgccccccctctcagatggcagctgctccttgggcagagttggcaatgtttttctttaaatgaccagatggtaaatattttcatgtcacaaaatcttcttcttctggtatttttccagccattaaatgtaaaagccctcctgagttcatgggctgtacctaaacaggtgttgagcccgattctgtggcacatgtggtttgctgccccctgggcattggtcagggggcctgggttctgccttctcgattgctatccgcgtgggggatctgggggagggatcactgttcttcttgcttttggcctccttggggaggatggggaggtagcccaggggtgctcacccaggccccgtgtcagtcttctatgaaacttttaaagaatagtgatgactgactgtctgtctgtatggtactttccttaaacctaaaactggtcccaaataaagtctcttaatttgaaagatgctgaagcccgggccataccccacactgattctgtgtctggggatggggcgtggggcctgggcctcactcagtgttttctctcagtcacctgggggagatggaagtggagccggccaagaaccctgcctgcctgcctgctggccgggactcctgagtcaggctctctggccctggggtgtgggcagctccagatggacccgcgatgtgcaggttcagctggcctggccggaggtgggacactggctttgctgtctttggagtgccccctccctctctggcgagctttggctggaagcagttctaccgtgttttggaaatgaatgaggccttcagaaggcattagtcagtgtgtgcctgcgctggctcagacagtgcctggtgagggtttgagtcatcctggggtgcccctggcccccacgccctccctctccagtgcaggatcattacccaaaaatctggcagggagctgccccacccacagggagcaggggcctccttcagcagtctcacctaatgttgctggagccttgggggatcagggcccatctcttctagagagatgtcagggcagggctgggcgcgatggctcacacctgtaatcccagagcttcgggaggccaaggtgggaggattgcttgagcgtagccattcgagagcagc

SEQ ID NO: 1716 - DNA, 3489 bp, Homo sapiens
ggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaa

SEQ ID NO: 1717 - DNA, 30 bp, Homo sapiens
gcctcctgagtagacgtttcccggccaagg

SEQ ID NO: 1718 - DNA, 336 bp, Homo sapiens
aacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgc

SEQ ID NO: 1719 - DNA, 488 bp, Homo sapiens
tggcatgacatagctaaagcactgaaggaaaaagtattttatcctagaatagtatatccagtgaaaatatcctttaaaaatgtgggagaaataaagacttctccagacaaactaaaataagggatttcatcaataccagatctgtcctataagaaatgctgaaagaagttcttcagtctgaaataaaaggatgttaatgaattagaaatcatttgaaggtgaaaaactcactaataataggaagtacacagaaagagaacaaaaaaacactgcaattttggtgtgttaactactcatatcttgagtagaaagataaaaaagatgaaccaatcagaaataaccacaacttcttaagacatagacagtacaataaaatttaaatgcaaacaacaaaaagtttaaaagctgggggatgaagtcaaagtgtacagtttttattagttttctttctgagtgtttgtttatgcagttagtgataagttatcatc

SEQ ID NO: 1720 - DNA, 60 bp, Homo sapiens
acctggtcatcttcccctacattgtagcctaccagaactacctgggctgtaatctaatat

SEQ ID NO: 1721 - DNA, 98 bp, Homo sapiens
ttcaggtatattcctccaaaacccacacagttcagagattttcaaacaccaggtttccatttgtattaaaatgggcaagataatgaaggcacaggctc

SEQ ID NO: 1722 - DNA, 149 bp, Homo sapiens
gacctattccatacctatcagactgacaatatttttaatgtataatgttaatgagtggcatgataggaacctagtgcactgttgctgagaacaacacagtggagaggaattaagcaatatctagcagagttgaagacgcatatacccta

SEQ ID NO: 1723 - DNA, 123 bp, Homo sapiens
gagaccttaaggatggccaccaccactatgaaggagctgttgtcattctggatgctggtgctcagtacgggaaagtcatagaccgaagagtgagggaactgttcgtgcagtctgaaattttcc

SEQ ID NO: 1724 - DNA, 69 bp, Homo sapiens
ctcccatcgcttcaacgagttcatgacctccaaacccaaaatccactgcttcaggagcctaaagcgtgg

SEQ ID NO: 1725 - DNA, 170 bp, Homo sapiens
cagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatc

SEQ ID NO: 1726 - DNA, 79 bp, Homo sapiens
gaacaagtggataaacggtaactgacttcaccccatctgagaaagtccagagagcagaggagttacctgagcctcatgg

SEQ ID NO: 1727 - DNA, 100 bp, Homo sapiens
tccttggtgattccgcagtgagagagtggctggggcatggaaggcaagattgtgtcccattcccccagtgcggccagctccgcgccaggatggcgcagga

SEQ ID NO: 1728 - DNA, 510 bp, Homo sapiens
cagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatg

SEQ ID NO: 1729 - DNA, 377 bp, Homo sapiens
atccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctgga

SEQ ID NO: 1730 - DNA, 95 bp, Homo sapiens
tataggttataagtatagctgcctgtgcttccaccacgagcacctggggtgtcttgtggcatgattgagctagctctgaagctgactccctcttc

SEQ ID NO: 1731 - DNA, 149 bp, Homo sapiens
cccgaatggaacgagcagctgagcttcgtggagctcttcccgccgctgacgcgcagcctccgcctgcagctgcgggacgacgcgcccctggtcgacgcggcactcgctacgcacgtgccggacctgaggcggatctcccatccgggccg

SEQ ID NO: 1732 - DNA, 746 bp, Homo sapiens
gccgcacaattatagctctccgtgacctccaactgttggctcacgtcatcctccagccttagtctctgagtactgaggcacaccaccatgccttgctaatttttttttttctttgagatggagtctcgctttgtcgcccaggctagagtgcaatggtgtgatctcggctcactgcaacctcggcctcctgggttcaagggattctcctgccttaacctcccaaatagctgggactacaggcgcctgccaccatgccttgctaatttttttgtatatttgatagagacggggtttcaccatgttggccaggctggtgtcgagctcctgacctcaggagatctgcccgccccgagctgccaaagtgctgggattgcaggcatgaagcactgcgcccagccgattttaaaaaattttttgtagagatgaggtctcactgtgtttcccaggctggtctcaaactcctagtctcaagtaatttttctacctcagcctccgaaagtgctgggattacaggtgcgagctactgtgcctggcctgttattcacctttttataaaaggagcaacccattttttcaagtcattactagatgtacagtattgtagagaagtctatattattgctttagaagcatgccaagctcgaagggctggcctggactctgacctatgctaaagcccatgtatgcactttattctactttcatctatacttttccccagtggcacatggtagggtcgaaataca

SEQ ID NO: 1733 - DNA, 164 bp, Homo sapiens
cagccgctacttcatggcccgggcacggcgggcgtcctgcggcggccacacaccatccgccagcgagagcagcgagctggccgcggcgaggcgtctcggtcacgagcggcgggcaaaaagccgtgggcaggcgggacttttgtccggcccgcaggcggaagctt

SEQ ID NO: 1734 - DNA, 199 bp, Homo sapiens
tggcctcttttctcactacagcttgtctttcagttccacaatctaaggaggataatagatagccagattttattggtcccaaccacatcgtcttccccacaaaccagcagctcactcacttttctattttttacgttggccagattagaaacttgtgtcatcatcatcattttcccctaccgtgtctcaaagatctagg

SEQ ID NO: 1735 - DNA, 126 bp, Homo sapiens
ccctagtaactgctgtcggtgtggacgctgtgctggttctgttttctaaaggagcagaaggacaggtctctgagacaggatcgttgtccctacaggaggaacagtggccttgcttcttagacggtc

SEQ ID NO: 1736 - DNA, 289 bp, Homo sapiens
gggatgacctcctattgtgccacgggagacacagggcttgagcccacagctggagggaaggtgccatccacactgaaagtcagccagccagccagtagaaattatttatgataatacaggaaccatggccagcatgacatttctacttccagtgggaaggcaggactttaggaatgagaaaggaactgggatggaagagagaggcagaaggggaaggtgggggacagtgaggaaaaacacactgattgagaagggaccctggggacttctgggatggtgatcgaccttg

SEQ ID NO: 1737 - DNA, 90 bp, Homo sapiens
tccgcgcggagggatctactacgagtcactggccccgtccgcatccttctccagcggccccgggggccgccgcgccttaactcgatcagg

SEQ ID NO: 1738 - DNA, 74 bp, Homo sapiens
tttcgtgtggctgatcaaagaaagaaggcatacgcagatttctacagaaactacgatgtcatgaaagattttga

SEQ ID NO: 1739 - DNA, 94 bp, Homo sapiens
ctgccctgtgaggagcgaccattctgctccatctgactcaagactcgggattatttcagcagcttggatgtctcagggcctatcacccaagagg

SEQ ID NO: 1740 - DNA, 58 bp, Homo sapiens
tctgccaatgtgagaagagtcaggaacaggatttagaatatgggcaaccttggttcct

SEQ ID NO: 1741 - DNA, 238 bp, Homo sapiens
tcccggcgtcttcctattttagacatctcgctgcctcagtcccttctaatgtttccagccaggctgcggggggaggaaaaagaggttactgctactttaaatgtactgtatgaaggcgagggctggaaaggggcctgcttgcaggaatacccagtcatctagttggaaaagccgccagatggaatacaaaaggaggaacccagacgctcatggagacagcctcggttcataaatcagg

SEQ ID NO: 1742 - DNA, 217 bp, Homo sapiens
ggcatcaagaatcactagctcctggttttcttctgacatctgcaattccctttcaaggttctcaactttatccttaagtgaatcattctcccgctcgcgttctttcagtttctctgcgatgtgcagctgcttcttttcatcggcctcaatgcgaactctcagtttctcgatgcctcttctcagctgatgcacttcctcctgtgttgagctcagcctc

SEQ ID NO: 1743 - DNA, 28 bp, Homo sapiens
agtcaaatctcctccaaaccagaccctt

SEQ ID NO: 1744 - DNA, 197 bp, Homo sapiens
attcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtgga

SEQ ID NO: 1745 - DNA, 203 bp, Homo sapiens
gctgcacaattagagccagcccacaggctgtgactggctatgaacttctctgtcatttttgggctgccaaacttaaacaccctttcgacaaagctcttcagtctgctttccctcttcagtgcaccctaagtcctgctgacatggaagtcatgagatcttccctggagagtgacctggccccacaggggactttgcataaacca

SEQ ID NO: 1746 - DNA, 61 bp, Homo sapiens
ggagtccaccatgaaacttgtcacgaacctttctggccagctgtcggaattaaaggatcag

SEQ ID NO: 1747 - DNA, 72 bp, Homo sapiens
ttccacatgattaatttccaacaagacacttgggagttatttactgtgttcctctggcagccaataaaatca

SEQ ID NO: 1748 - DNA, 142 bp, Homo sapiens
tcttattttctaccactgtcccttctacaagcagtaccccttcctgtggccaggaaagaagattccagcgccctgggcaaacaccacaagtgtgcgcaaactaatcctcttcttggagaccactctgagtgagcgggcctca

SEQ ID NO: 1749 - DNA, 576 bp, Homo sapiens
ggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaaca

SEQ ID NO: 1750 - DNA, 192 bp, Homo sapiens
tgtgggtgttgacagtgctcattgattgaaatttgaaacgttcagaaatcccatacctgaagatggtcacatattctttacatcatgattcagtaactattcaacagttatgtctactaaatacagtgaacaaaacagtataaatgtttacaccattcccctgtgaacagggcttttgtgcacaatagtaac

SEQ ID NO: 1751 - DNA, 361 bp, Homo sapiens
ggggtgaacatgagtaccacagttagactgaggttgggaaagattttccagacaattggaagagcatgtgaaagacacagattttgagaaatgttaagtctagggaactgcaaggcttttggcacaagaaagccactgtagactatagaggcaggatgcctagattcaaatcccaactgctacacttctaagctttgtaattttggcaagtttttaccctctattttcttatctataaaatatagattttatatatatagatatagatatatagatagataataattgtgcatgcctaataaagttgtcaaagattaaatgttatatgtgaagtattttgtacggtgataggaacccagga

SEQ ID NO: 1752 - DNA, 52 bp, Homo sapiens
gattatggtgcaaggtagaaggtgagaaagaatgcagaaccaagctagaccc

SEQ ID NO: 1753 - DNA, 70 bp, Homo sapiens
gtgggaaggtggcatgggatgaagttgtcattactgagcatcttctctgtgtaaataaagggcagtacca

SEQ ID NO: 1754 - DNA, 123 bp, Homo sapiens
ggaccgcgctaataaaaactgccgaatcctgcagtaccgtcttcggaaagccgagcagaaaagcctgaaagtggctgagacgggtcaggtggatggtgagcttattcgaagcctggagcagga

SEQ ID NO: 1755 - DNA, 341 bp, Homo sapiens
gtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaa

SEQ ID NO: 1756 - DNA, 261 bp, Homo sapiens
gcccatgaatctcatcggctttatcatgaaagtttattgtttttaatcctagtacaatcagctaccagttacatacagtaaaaaacagaaacagccacaaagcaatgatgatagagatagtctgtgacattgtacagtggaggaaatactctctgttggaatcctccagcagacccccgcctggcttcagcagttaagctatcactccctccctccccaaaacagttaaaagaaaaattaacgtcttgcttgggtacagca

SEQ ID NO: 1757 - DNA, 87 bp, Homo sapiens
tgtctgcacaaggattaagacctcgcactgtgtccagcccgatcccttacacaccttctccgagttcaagcaggcctatatcacctg

SEQ ID NO: 1758 - DNA, 372 bp, Homo sapiens
cgttttttaaccagggatgatgccatccccctccccgaagggacagatatctagagacagttatggttgtcacaactggtgggggcagctacttagcatttggtagatgaaggctgttaaacatcttacacgtacaggacagctctccacaacaaataattatctggcccaaaatgtcagtagtgctaatttgggaaacctttatctaaacaataattatcaatggccactcaagcagtaagataaaaaagaagtttgatggggatatttatgatgggtggaacaagctgttaacacctgaccgaaactcaacccactgattgaccttaaatgggaaactgatattaggtgcctcctgtggggatataatag

SEQ ID NO: 1759 - DNA, 537 bp, Homo sapiens
ttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagta

SEQ ID NO: 1760 - DNA, 49 bp, Homo sapiens
tggcttgcttggcacccagggacagtagctgtttggctctccacccaat

SEQ ID NO: 1761 - DNA, 82 bp, Homo sapiens
aggccagtatgggtgcaaggggcccgcgttggtagtcatgtctttgtgggctgatggctgcgtgtgtataggcaggaagtta

SEQ ID NO: 1762 - DNA, 35 bp, Homo sapiens
aaagcccacggtcatagacagcaccatacaatcag

SEQ ID NO: 1763 - DNA, 229 bp, Homo sapiens
cacctataatgagctggacactctatgggccttgcaatttagacatgaatagagttctcaggtaccttacattctaattagaaggagaactttgacctctaaccaagacctgtttaattcataggagggtttcttttcttttttttaaactgcactcacggtcatccccccaaaggatgagggtttcttaagttatgttgaaaattcaaaccttgagtccgggcatggt

SEQ ID NO: 1764 - DNA, 867 bp, Homo sapiens
agctgcatggtggtctcaagagatctcaagtcttgctgacatgcatatagggtacaacttattacaggttcataacatttgcttctcaattcacataaaagagcaaattgctgtggctttgctttttaatttttttttttttttttaagagagagaggagccactcttgcccaggctggagtgcagtggctaactgcagtctctcactcctgggctcaagggatcctccagcctcagcttcctgaatagttgggactacaggcacaagccactgtacacagctgctttgttatcttctacatatataccaaagggataagttaggaacaccagaaactcagtagtaactcactttaaccttgcttctggggctccaattcaagtgatgctcaatttcaaggtacaaggaaaaccatgagaatataaagtcataatgccatttccactcagatgaaaagatttatctatctttagatactcaaaattattcttggcattttagcacttttggtacacatttcctgatgtaggaaatagtaaaatttcagagcctatggcattggctttcaccacctatgcaattttctacacatctgaaaattaccagtttatctaactccttaaatgttcctctcttcaacaacaaaaaacacaaacaaaaattgctggaagaaacaggaagcatccaggtccaaatgacagcataacagactatgaagaaacagggcttaagtgcccatctagaacaagatggtctagattacaataaggaccccatgggacagaacatcaaaacattcaactttcaagtaaatgtcttggaagtaaacatttaaaatttataggacttcctctggcatgtaggta

SEQ ID NO: 1765 - DNA, 78 bp, Homo sapiens
accacccttcccaacaatccactagcaatccagaggccaccaccccttcccaacaatctggcaacgacccagaggcca

SEQ ID NO: 1766 - DNA, 137 bp, Homo sapiens
aataatgtacaaattggtgaataaacacaacagagccaacaaacatcccacccgagcccatacagcaaacaggaaatgagaacatttcagcaagatttcaagcaagcaagagatgatgggtcattgttcaggtgact

SEQ ID NO: 1767 - DNA, 61 bp, Homo sapiens
aagcatgtttggtgagctgctgcagaatgccagcaccatgggggatctgcggaactgtcca

SEQ ID NO: 1768 - DNA, 354 bp, Homo sapiens
gccaatcatgaaggaccgcgtgctgtatgactctgtttataggaaatggtctggaataggcaaatctgtagagaccgaaagtaaattatggtttcctaggcctaggaaccagtgaggggtgaggaggatagctaaggggtagaaggtttctttggggataatgaaaatactctaaaattgattgtggtgaaggttgcacaattctgtggatatactaagcacaattctgtggatatactaaaagcaattgaattgtacactttatgtgggtgaattgtatgccgtatgaattatatctcaacattgtattagaaaataaaattaatgaagcatagaagttacggagaactactg

SEQ ID NO: 1769 - DNA, 47 bp, Homo sapiens
acagttgcaggcacgcagcggtctcccagcgtcagggcgcaccgcga

SEQ ID NO: 1770 - DNA, 273 bp, Homo sapiens
gtggtttaatgtcttcaagaacttcctgtagttaaatttatttcagtgagatacttttggaattaatgtccttttactgagacctgatggcttttatgtattttagggtaaatttctgaagttttattttcttgttttaaaattgtttaaatgtgtttggtaactattggaaaattttctcttcttaattatgttctgtgtattgtattgatcctgaattgtatagttaatagtgacttttcaagatggggcatgctcaagatcgaacagata

SEQ ID NO: 1771 - DNA, 358 bp, Homo sapiens
cctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattg

SEQ ID NO: 1772 - DNA, 38 bp, Homo sapiens
tgatcagaaacattggggacttggcacttatcatgaaa

SEQ ID NO: 1773 - DNA, 104 bp, Homo sapiens
acttcgggctgtcggagtttattgaatccaccctttcaggacacagcctccccttgctcagatacgatagctcctttgaggccatggtcactgcattaggaaaa

SEQ ID NO: 1774 - DNA, 421 bp, Homo sapiens
tgctaaggccatccattgtcttttgttaggagtcaaacaaaattttagtaaccaaaacatattttcaataaaattttatatgtatataagtaaataacaaaacaacaaaaaacaaaaaaagaacaaaacagcaccaagaacctatgtaaaatttcatcatacaatttctatgcaagctgcttgattacagaaaactgttcaaactgttcatcaaaaactgagtgggattttccattgatatttcagatattcaaatcaacccatattctgagtatcaatctgaattgcacaggttaagatgtgaacccttcacatagtgttgaagatgtgttgaaatctgtacttgaattggcattgttttcctcagagttaggctgccttcatgagaaatatcttctatccctgagagatcagctacatc

SEQ ID NO: 1775 - DNA, 83 bp, Homo sapiens
gtgtttacaatccacttttctccaaatgtgccatcacgctgtctgttgcttgaactcctggatgtcagtgtttcggaattgct

SEQ ID NO: 1776 - DNA, 60 bp, Homo sapiens
ccagaaactcatctcgaatgaagtacttggcccgggtcacgcgtgggtcctctccgggct

SEQ ID NO: 1777 - DNA, 157 bp, Homo sapiens
gtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtccta

SEQ ID NO: 1778 - DNA, 33 bp, Homo sapiens
ttttttggcttagtatgttgaaataaactatgg

SEQ ID NO: 1779 - DNA, 43 bp, Homo sapiens
aatactatgggagttggcagctagaaacacaagttaggaaagg

SEQ ID NO: 1780 - DNA, 207 bp, Homo sapiens
ctggtggctcccaacatgataggacacagaaactcatgctcaatggtacccgtacttcgataaggagcaacagcaaagtcagatggtggaagatctgtcaggtgtttacttatgttgtagatatggttacaaagctcagggagcccctgtctaatgggaaatatggctaccaaactgatgatggcctcccagggaatccaattctgc

SEQ ID NO: 1781 - DNA, 137 bp, Homo sapiens
tgcttctacccatgcccgaagtgtaactccaacaagtgtgggcccgagtgccgctgcaaccgacggtgggtttacgatgccatcgtcactgagtcaggagaggtcatcagcacgctgccgtttaatgttcctgacta

SEQ ID NO: 1782 - DNA, 40 bp, Homo sapiens
atcttgccatttgtgatgagtgctacattacagaaatgga

SEQ ID NO: 1783 - DNA, 153 bp, Homo sapiens
tgtagaaagcatggggctaaaagtattttgacataatttatccaaatttagcctggctataatttctgtaagccttgagttagtcagaggatgagtaacaatagagaacatttttaaaaaactaattacggttgaatattaagtctgacccaa

SEQ ID NO: 1784 - DNA, 29 bp, Homo sapiens
agaacaagccttcagacatttgctatatt

SEQ ID NO: 1785 - DNA, 103 bp, Homo sapiens
ggcgaagagtgtcctcggctctcctcttcccagggagcactcggggcttcggactctgcagtggtttgcaaggccagggccaagtggtcacttcactcactga

SEQ ID NO: 1786 - DNA, 29 bp, Homo sapiens
ccatgcgccgaggcacttccaggcttcac

SEQ ID NO: 1787 - DNA, 68 bp, Homo sapiens
catttatttatgatcaaccagagagactaaacagtggactcatgggtttggactctattgcaattcaa

SEQ ID NO: 1788 - DNA, 48 bp, Homo sapiens
tgagtgacaccgtgggattgcagaaccacacgctaaccatgaagaatt

SEQ ID NO: 1789 - DNA, 705 bp, Homo sapiens
cccggactcttggaactgcgtttcttccctctcacccatcctgaccctaagaagctgagagaatctgtgcccctcttggtagactgggaaggcgggggagaagcccctctgccctcgtcacccagcaagggctagtgcagcctcacgttcatgtggattcacagccagaccctgttccaaggcagaggcagtctggtcaggacctggcagaatacacatggggtccaggcagctcccgagggagatgccccaaggttacctgcgatgctgttccggtttgaaccatgtggatagttttttttttttttttttggagactgagtctcattctgttgcccaggctggactgcaatggcacaatctcagctcactgcaatctgtgcgtcctgaattcaagtgattctcatgcctcagcctcccaaatagctgggattgcaggcgcccaccaccacgcctagctaatttttgcatttttagtagagacggggtttcaccatgttggccaggctggtctcgaactcctgacctcaaatgattcacccacctcggcctcccaaagtgctgggattacaggcgtgagccaccacgcccggccccatgtaaacactttacacgttcaaaatacaattaaaaaaagaaaggaaggaaaatcctgaaatagaactgagtcagaataagtgaccctccgtgcgtcatgttgatagc

SEQ ID NO: 1790 - DNA, 191 bp, Homo sapiens
tccagggaacatacacatatggccaacagcaccagcaaaggtgcttgatagcatcactcatcagagaaatgcaaatccaaatgacaccagaggctacttcacactcattagaatgattataaccagaaagtcagataataactagtgttggcaagaatgcgcagaaattggaaccctcttacttactggtg

SEQ ID NO: 1791 - DNA, 119 bp, Homo sapiens
tgtccaatctgtcactaggtccatgtgtcattgtttttcctccaaaatattccttcatcctgagctctttgtcacctaggacctggactactacagtaaccttgctccttgacttcaga

SEQ ID NO: 1792 - DNA, 426 bp, Homo sapiens
atggttctaccatgaagacacacgcactcaaatgcccactgcagcaccactcacaacagcaccgacatggaatcaagctggggcctgtcagcggcagacggataaagaggatgtggtccatatacaccgcggaatactatgcagccataaaaaggaacaagatcatgccctttgcaggaacttggatggagctggaggccattatccttcgcaaactaatgcggggacagaatcccgggcactacacttccccacttacaagtggaagctgaatgatgagaacacagggacagaaaggggccaacaacacacactggggccggcctgagggaagagggagaggctcagaaaaccattttaacaaaactgtcaggtacccatgcttggtacccggtgctgaaatgatctgtaggacaaaccctagtc

SEQ ID NO: 1793 - DNA, 30 bp, Homo sapiens
gggccagctttgataatggagcgagatgcc

SEQ ID NO: 1794 - DNA, 269 bp, Homo sapiens
cctctatcatggcagggacttcccaataaattctatactcattgtggccagctgaacgcctgacatttagtagactcctcaaaaatgatttttgaatgaatgatgactgaccaactgaatgaatgaccaatcttaaagcaccagtgaatgtttttactgtcttcacagagctcagaatagatccttggaagccattctggaaaagggcaactttccaaggatgttttcaaaaagaccaacatataagcacgtgtatttggttgaccctc

SEQ ID NO: 1795 - DNA, 96 bp, Homo sapiens
tcttgcatgcccaagtagagggatgcgtgagcaccatgctgagcttggggccacctcctgacagcagccctgagacgcccatccaaaaccctgttg

SEQ ID NO: 1796 - DNA, 98 bp, Homo sapiens
tggactctggacttcgcaggttcctgcctgtcacgccacccccttcctgggagcagcgagcagtgccccaggcccgagttggagcacggtctctatgg

SEQ ID NO: 1797 - DNA, 776 bp, Homo sapiens
ccatcacgtatgtcgcagcagcatttcacccctgaagtctctaaactctgagcctgaaaagatttgtatttaatacacataacattttttagttcattctgcctttcctatttgttccagtttttgcttggttttagtttggaggggaacttaagtacacagatccttatctctccccatcccctagcctcacaaaacacagttgagagtcttttaagtacctgagctctcgaagctacccagaactgaactagactcccctaccttagactggtaccctcaaacacaggactgaagcttaattgggaatttggctttatggagaaaagaatctttttcaaagtttgtgtcggaaggggagggtgaggtttgcccactgtctctgcaggaaggctccggcttaatctaggaagtagattccagctgcacgatgaggaacacattagcttttgggatcaaaccaggaatatgaatctgtaattattaagctcattgccaacccacaagatatgtttctgaaaacctgtagtttcttaatttaagtccatccccttcattaacgctacagttgtgactcacactgatcccaaacttttaagtgctaaatattaacatttagcattaactgtcttgtcaagcgaaaggccttctctacaacctagtccatctcacttctggtgctacctgagttggacagaattctagctcatggttgctaggaaagctaggcctctgatcatagaagcagatagcttcagtcccagtctaggcctaga

SEQ ID NO: 1798 - DNA, 103 bp, Homo sapiens
atgtctgcaggtttctccttgaagcaaatgtgtgggatcattgcatttccagaaatctgcctccttcaccctccgttgacagtatatgtcatgcctcactttc

SEQ ID NO: 1799 - DNA, 32 bp, Homo sapiens
atttggagactttcggcttgtttcaaatgata

SEQ ID NO: 1800 - DNA, 48 bp, Homo sapiens
atggctcggagtctcggggtcctggtggcactgccattcccgctcccg

SEQ ID NO: 1801 - DNA, 114 bp, Homo sapiens
gctctgtgaggctgagtaaacactattctctaacatagggacgacatgggcaactgaaaggattcaatgtaagtaatctctgtgaagctcctagcagagggttagatgcacaac

SEQ ID NO: 1802 - DNA, 449 bp, Homo sapiens
gagcactgacctttgacgtcctttgttgtgaggaaagtccatctatgtgttagttatggaattaaacactaatacaaacaaattatcataaaaatgaaacaaaaacaaaaccccagctgtttatagactccccttcccagatgtatagctgggagaggtccgtctcacactggcttccccctctctctggcccacactcctgtcaccatctccattgcacccatagtggaaatagctaggaagtgaaaacagctaggaagaagaaagagaaacaaaaacaaaaagaagcaataatatccaagacaagccctccccacatctaaattacaaaattgttataagtaaactaaaaagcacattttctttagccaggtagaaaaattaatatgtcaactgtgaaaaaacttcttttgatttgatagaatagacagccatggtgttgtttttca

SEQ ID NO: 1803 - DNA, 217 bp, Homo sapiens
atagcgctctctcgacgtcactgtgtcccggcttacaactagaggtgtcgcacacacccacttgggtgcctccccttccaaaaccaagcagaaaggcgtctagaaaattagaaggttttgccagttggtgctggcgtagaggacgtttcgaaggcgcttggagcaccccaccgttgcactggatgtagctaccccggcttgtggtcaatagagctcc

SEQ ID NO: 1804 - DNA, 227 bp, Homo sapiens
ggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgtta

SEQ ID NO: 1805 - DNA, 199 bp, Homo sapiens
tgccttcaagtgttcgtaagctagcttcttctcgcgcagtcatcctctctcttctcgctgaattctgagaagcgtgaagaggatgatttggatgtccaggatcaccagcagatgctaatgcagaaccataacgtaattgagcttcagtagaatccataatactgaccatccagttccaagtgggaataagcttttcttc

SEQ ID NO: 1806 - DNA, 100 bp, Homo sapiens
atcttcagctcctgctaggcgccggggaaagtaccaggcgctggcctgtaacctccttccggctctgtccccatcagcggctcccccagaagtgatggcc

SEQ ID NO: 1807 - DNA, 130 bp, Homo sapiens
gtgctgcctttgcttcttatcattcatggcagattgtttgtgctttcaacatttcatttgaaatgggagaagataaaatcacttgatgtaacctggaaactatgctttacatggcaatcaaagccttttg

SEQ ID NO: 1808 - DNA, 277 bp, Homo sapiens
ctgagcgcatcctggctgcagttctctgctcaatgttttcttaaaaacatgtattttttcttttgcctcatgtttgttttcttaccccaaatgttccttgcttgctttgcacatgccccacctcccacccaccaagacccattggaatcccaccactgcctctactaggctgcctgagttcagataatgatctcaaaaacagcactcgctcccctcacccactaaccccctggctctaagcagcttcctttctcagagggccttgcaaattgtcaga

SEQ ID NO: 1809 - DNA, 99 bp, Homo sapiens
accctgtgcatgttccgatgaaagagggccccagagatgtggtgtggaatgatttcctctggggagcagaaggcagaattgccatgcccaagcccgagc

SEQ ID NO: 1810 - DNA, 64 bp, Homo sapiens
ccaggggcttcatgctggggctcatcatctgtggagtggacatcttcacgcacagaaggaggaa

SEQ ID NO: 1811 - DNA, 377 bp, Homo sapiens
tgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgc

SEQ ID NO: 1812 - DNA, 186 bp, Homo sapiens
atagagtaatttcagtagatggttgggggtcaaactggagtataatgggttaagaagtaagtcaggaagtagagggcttttcctggtgttagggacaatataaatgaagacatggagacaggagtgggcttggcgaacacaggatgatgggcatcagcctgagtgaccaggtgttcgtagctcaga

SEQ ID NO: 1813 - DNA, 75 bp, Homo sapiens
ctgctggggtgaagttcaaaatccctggccactggttcgtgctagagatgctggactgcggattaatgggaaccc

SEQ ID NO: 1814 - DNA, 301 bp, Homo sapiens
ccactcccggccgtgaacatattttttgggttgctggagttcatctataagtcatttttgaggaataagatttatgttaagactatcaaacacagtgttgcctacaatagcaaaaatgtgaaaataacaacaacaacaaaacagcagaggaattgttatgtattttgtagtctatctatatgatgcctatttttaggctttaaaaagtcttcaaaatctttaatgactgatttatctagttaaatgcttaatccttagcaggctcttattctttaattaaacgtgcctttgagtagatgtg

SEQ ID NO: 1815 - DNA, 495 bp, Homo sapiens
gcagacttcttggagtggtagttcatggtcttcttctaagaaggctgtggatgccttaaaagcattatttgacgctggctcccatatctcactgccctctccaaaaaatgtgttaccctaacatagaagtatcttttctcagaattcttcagtatattatgaatcagtgactaccttttctctcccttgaaattttcctgtaacttaatgttcatttccttttgtttcagtaaaccagtctcaactcttttccttttctctttctgttgtacctctcatttccccgacccttcctgtcctgtagatggcatttcataattcacattgataataattgctagaatttataggcatttattgtagattaagtagagcatttattatagattaagcctatacgtaacttgttgaattctcataacaaccttaggaagtacatgttgttacttccacattttatagataaggtagccagtctgctctagagaaatttta

SEQ ID NO: 1816 - DNA, 107 bp, Homo sapiens
gactcttccaggcaatttccatagatctgcagtcctgcctctgccacagtctctctgttgtccccacatctacccaacttcctgtactgttgcccttctgatgttaa

SEQ ID NO: 1817 - DNA, 192 bp, Homo sapiens
tgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcgg

SEQ ID NO: 1818 - DNA, 115 bp, Homo sapiens
gatcggctatcctaaaccagccctgctgcactccaccttcttcccagccctgcagggcgcccagaccaaaatgagtgccagcgaccccaactcctccatcttcctcaccgacacg

SEQ ID NO: 1819 - DNA, 200 bp, Homo sapiens
ctgggcacaggctaggcactgattctgctggttctgagaaacataaatggtaccatagggaggtgtttcctcctaagtggcaggaggatgtttgctgggagttaagtgaaccaattcctcctctgcttacaccacgtgggggtaggtccagaactcaggccttgggaacatatgctgtgctctcttctacaggcgctgtg

SEQ ID NO: 1820 - DNA, 670 bp, Homo sapiens
aggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaata

SEQ ID NO: 1821 - DNA, 91 bp, Homo sapiens
agacagattatgttggattgagaaatgggtgacagtttaagatgtcgggcaggaagtgtaggctcctcttttaagaaacatgaggtgcctg

SEQ ID NO: 1822 - DNA, 33 bp, Homo sapiens
aagaaagcgcaaggaatgtcctgaccaacttgg

SEQ ID NO: 1823 - DNA, 55 bp, Homo sapiens
tcttggcatcgccacacccaggacttgctcgtgccgcaattccccacggaaacaa

SEQ ID NO: 1824 - DNA, 73 bp, Homo sapiens
gtatctatctcttcattggcatgggcatcaattatcgacttttggcaaaagaacagaaagcaaacgagcagaa

SEQ ID NO: 1825 - DNA, 101 bp, Homo sapiens
aggagaaggaaagatctcgttcttagcgaaccccagggagtgtggcctccctccaccccatgactctcgctaccagggcccggtggtcactatgccacaaa

SEQ ID NO: 1826 - DNA, 494 bp, Homo sapiens
ccacaactgcgagggattttcttttacactggccacagagcgtttattgacaccaccactcctgaaaattgggatttcttattaggttcccctaaaagttcccatgttgattacatgtaaatagtcacatatatacaatgaaggcagtttcttcagaggcaaccagggtttatagtgctaggtaaatgtcatctcttttgtgctactgactcattgtcaaacgtctctgcactgttttcagcctctccacgttgcctctgtcctgcttcttagttccttctttgtgacaaaccaaaagaataagaggatttagaacaggactgcttttcccctatgatttaaaaattccaatgactttcgcccttgggagaaatttccaaggaaatctctctcgctcgctctctccgttttcctttgtgagcttctgggggagggttagtggtgactttttgatacgaaaaaatgcattttgtgcagctggtgaggtataatcc

SEQ ID NO: 1827 - DNA, 103 bp, Homo sapiens
cctggccaccggcttgcccaccgtgccctctgtgcctgccatgccgggcgtcaacaacctcactggcctcaccttcccctggatggagagtaaccgcagatac

SEQ ID NO: 1828 - DNA, 409 bp, Homo sapiens
agaagtctccgctgctcgggccctcctggggagcccccgctccagggctcgctccaggaccttcttcacaagatgacttgctcgctgttacctgcttccccagtcttttctgaaaaactacaaattagggtgggaaaagctctgtattgagaagggtcatatttgctttctaggaggtttgttgttttgcctgttagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaata

SEQ ID NO: 1829 - DNA, 115 bp, Homo sapiens
ttagagtgcctgtgagatactaggcactgtgggacaagaccaagagactgagtcaggcagacctatctagcccattaagaactgctttaaagggacacatctggcaacagtaaaa

SEQ ID NO: 1830 - DNA, 318 bp, Homo sapiens
gtcatctatccgaaggcattttgtaattgtgcttgtgtgtgtgtgtatatgtgtgtgtttgtgttacagtttaaaatcttactgtattacctacatcattgaaagaatcatcatgcagcctttctcaacaaaggcttatctagagaattataccctaatatcctaaagtatatttaatgaattaataaatatttaatgaattaacttactcattcctgggagaattgagaatagagtcattcaaatcattttctatggggttaaattctttggctgaacccgagttgagaaaggctgctagagaatgcattgaagacc

SEQ ID NO: 1831 - DNA, 67 bp, Homo sapiens
atccagagctcgctgggcatccacccggtgggagacaggccagcacgaccaagtggccagcacacca

SEQ ID NO: 1832 - DNA, 250 bp, Homo sapiens
ccggaacatcgtctagctggtgttaggaatgtttgcttaatttccagacttttttttaaaaacacatcgtgggttttttgaggctccaacctgattagtgcatggtcagccctcaatgaaggctgaggcatctctgactgaggtgtttttgtttggttttgttttttaaaatcatgtatttgctacaaagtattgtacttgtctcaatgggaatggtgtaaaaaacaaaaggccttatgtgatctgtatc

SEQ ID NO: 1833 - DNA, 70 bp, Homo sapiens
caaaggcgagtgcagctttagctgccttggagaaactgttttctggacccaatgcggcaaataataagaa

SEQ ID NO: 1834 - DNA, 102 bp, Homo sapiens
ggcagcttattcacgtggcctttcctccgctgctgtgattttatctttgaatgtggcctttggagtgggtaaagtaggacttagacgctcagtgaagtggct

SEQ ID NO: 1835 - DNA, 251 bp, Homo sapiens
aggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaataga

SEQ ID NO: 1836 - DNA, 45 bp, Homo sapiens
ggagatgcacatatttacctgaatcacatcgagccactgaaaatt

SEQ ID NO: 1837 - DNA, 189 bp, Homo sapiens
gacttcgcaggtgagcagtaacggaaatcagccccgtttattcctcccagcacctgccttatccaactccccacgctgtggctgagtcccagcctgctatggaagcatcactggactcccattgaactctgtgcagattcgctgttcgtagacatggtacctgatggacaccaagctacgtacagcttc

SEQ ID NO: 1838 - DNA, 59 bp, Homo sapiens
aacaggatgtagaaagacccatgaagaaagaaagaagaaagctatggttccgaaagcag

SEQ ID NO: 1839 - DNA, 66 bp, Homo sapiens
gacgtgcgggatcaagttgctattcatgaagctatggaacagcagaccatatccatcactaaagca

SEQ ID NO: 1840 - DNA, 324 bp, Homo sapiens
tgcccaatacacgattttgacattcagtcatgattgttttaaagttttattgtagactttgctgttggatacaaaatgaaggcatacaactgtcacaggcagggcagtaagtacaaagtctaagctgtaaaaaccgtttgaaaatataaactcgtttttggaatacatgtgtcaaaggctgcccatgttaatacctttggtataaaacggtaacgattcccttgacaaacccatccatcacctgacgcacattcacatctcctggtaactactctacctagtctagtctcaaccacccctgtcagtcacgactcactcctgttc

SEQ ID NO: 1841 - DNA, 182 bp, Homo sapiens
gcgcatggtcatcttagctttcgaaagaggactgcactgtttaacattgaagaattacatggggaatcacaaatatattgctttagtactgcatgttctgttgtggtgagggaaagaaacatgctttgaaggttttcccttgtcaacagaatgtgtgtctgtagctgtgtattgcgcatgta

SEQ ID NO: 1842 - DNA, 28 bp, Homo sapiens
taaggtccctccagtgtacaacaatttg

SEQ ID NO: 1843 - DNA, 175 bp, Homo sapiens
cacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgc

SEQ ID NO: 1844 - DNA, 261 bp, Homo sapiens
gcacgtgagggtacatccagtcttctaccagctaatacgtcagagaccacataatgttaggctggaagagaccctaaaggttatataaaccaattcccttattttagagctgagaaatttcaggtgcaaagaagggagaggctataacatggtggcactagaataagactgccgggtttgaatcctggtgcaactacttattacctgtgtgatcttgggaaagtgacttaacctttctgggtcacagtttggatacctata

SEQ ID NO: 1845 - DNA, 30 bp, Homo sapiens
tctgaatgctgaagtgacagttggagatgg

SEQ ID NO: 1846 - DNA, 446 bp, Homo sapiens
gatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgatacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtg

SEQ ID NO: 1847 - DNA, 40 bp, Homo sapiens
catgagcctaacaccctgccggttttcatgcccgctgcag

SEQ ID NO: 1848 - DNA, 268 bp, Homo sapiens
ttctggcccaacaggcttctttccaagttaatgcagctatattccaaggaagtgttttatgaaatctgaatactcaaacaccccttctgtattttcactcaaccatcattgtattagatgatacataaggaaagtgacttagggaagtaagttcagaaggaaatgtgttcccttctccctcatattatcttttcaacagaggcctggattgctaaatggattatgaaagcaaattgctactgggaggtgatggtcaaaagcaaactta

SEQ ID NO: 1849 - DNA, 140 bp, Homo sapiens
ctcataaaacttagtgaacacactgtgttatgccagctcaaatctacagtagccaccaaaaccatgacttaatattttgagccctagaagaaaggggtgtgctgaggacaagagtggggaaataggaacactgaccagta

SEQ ID NO: 1850 - DNA, 233 bp, Homo sapiens
ggcatgggtattttccagccccagattgcttggtaaaatgatggtggagaacaaaaaggtgagggctgcagtcctagctggccaaagttcaaagaaccatgctgggctggggctaaaagaaaaaccaatggaattattatgcccccaaacttagctatttggaagaaaaaacacaagatttaaggtaatctgttgttaaatgttatttggatacactaacatcgtgcatgaaa

SEQ ID NO: 1851 - DNA, 68 bp, Homo sapiens
cctcctgtgtttgacttcccgggatgggtccttgcttctcagctgtgtccgaccccaccatgtaataa

SEQ ID NO: 1852 - DNA, 223 bp, Homo sapiens
taattcagtatgctgtccaggggcctggaaatcactcagcacagtctaccaccattggcacatgaacacttctcccagggtctaaggacaggctgacataacatgctaataccaccagagctggcactcacccagatgtaccacatcaggccaggaagcagaaactaccaacatcccagcaaaccatgtggaggcccccaaatcagactgcttgggcctaaca

SEQ ID NO: 1853 - DNA, 199 bp, Homo sapiens
ctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatc

SEQ ID NO: 1854 - DNA, 169 bp, Homo sapiens
ctggtaattgggctctttgttcttctggagcttccgactgcataagcagtgaataggtgattttgttctcagcatggagaaggcagaaaccagcagtagggatccacagagagggcataggaaagaagatgttaaagaggctggacattggggctgatgctggtcatcc

SEQ ID NO: 1855 - DNA, 186 bp, Homo sapiens
cctgcaggcgttcatatgagagatgtgcaatgcctgtgctaggacagtggtggcagagacagaaaacagaagagagaaatcaggaaccatttaggaaataggatcagctgggcttggtgatgaaattcaggagatgatgtcatgggtgactcctagttggttcttggagttgtgataatgcccttc

SEQ ID NO: 1856 - DNA, 61 bp, Homo sapiens
ggattttggacaagggctgggccaggcacagcactgtgttctgacccgttacgaagaggta

SEQ ID NO: 1857 - DNA, 31 bp, Homo sapiens
cccacttgggtccttggcgttggtggcagca

SEQ ID NO: 1858 - DNA, 405 bp, Homo sapiens
tcgttgggacactgaagggagatccagagttccgactgaaatttgagaagctctttgctattcaagtggatatgtgcagttgacagtttgagagatgcatctagggttcagtaaagacaacacaagcctgtctttagggtctacctgtgaactgtgaacacagcaatgagaatgatggacatcacctttaagtatttttctagactttattactcatgtgtttgtcatgaggtgtaacttagtagttcatagtcctataatgtatgttattgactaggtagcatttatttttctaattgtttctgttatagtgctgccacatgtgtttcccagaaacgcattttacccacagttcttagggttggcctgattagtttaattgctgtctgaacctgcttcttactg

SEQ ID NO: 1859 - DNA, 72 bp, Homo sapiens
tgcggcctccgcgacccgctctcacctctttttagtcgctggcacaacgaacactcccgctccgaagccgga

SEQ ID NO: 1860 - DNA, 577 bp, Homo sapiens
cctgggaccgattaaggtgtcaacattttaaaattactcaagatattaaccagaaaagatgattatggcctttaaaactattggacaaactgatgctatttaacattgttcacagccatttaatttgaataacaaattttagattctaagtaggccataacttctttgcaaaacaattgatttataaaggtacagtttcagaaggtaacagcatgagactagtcttcctataggcacattttagtagactgctcttctcatccctggtcaaggagcttctctaactgatggttgatatttcgcagatggctttcggctcccagaagtgttcttgctttaaataacagagctggaaggctggatgaatcatactgttgaaagaaaattatataattagcaatatcaaaaactcataaccttgtccttagatagcccaatcttatgactaatgcaaattttgattgagctttccattaactactcctcctctcatttttaactaggaccattaagacaattggttttaatccatttcccttagaatataattgatcacaaagttgctagggagctgctc

SEQ ID NO: 1861 - DNA, 81 bp, Homo sapiens
gtttctgaaatatgagccagccttgacagtcacgatgccccatccacccgactgggcacctcctgtcctgacaccatcctg

SEQ ID NO: 1862 - DNA, 140 bp, Homo sapiens
ctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaa

SEQ ID NO: 1863 - DNA, 99 bp, Homo sapiens
aacagaaccagtgctccaggtgttttttaattttttaatttatttttattttttttgtatatgtatatatatgtatgtatattttagaggaccagggtc

SEQ ID NO: 1864 - DNA, 272 bp, Homo sapiens
gcatttatatagagctttcggtttctgtctgtttaatttgatgctctgcttattcagttatactagatgtgtttctcagagttatccagtccatacgtatttgaagagacaatttggtgtagaattgttagtgtccaggctcttccaagcaaggtcttccaaagggatatctcaaaaatattccttagagttgaagtggcaatgttatatagcctaacaattttcatgctattaaaagcttataatagcggatcattaaaatgcgagttaca

SEQ ID NO: 1865 - DNA, 52 bp, Homo sapiens
atcagaagatttccgggaatggccctggccaaaaccaatgttgaccaaacca

SEQ ID NO: 1866 - DNA, 231 bp, Homo sapiens
ccatatcgggaaccaagtagtactgtaatgggtttggccagatatcatctttgatgacctctcctaactcatcagcacctgcatcagaatggtcagtaaaccaggtaaagaagctctctggttcctcatgctgcctcttcctgctggctttattctgtgtttgacttgaacgtttcgtcaaatcctttccagatttccatttgatttcggtggacttcgaagatggatcac

SEQ ID NO: 1867 - DNA, 78 bp, Homo sapiens
caatcattatgttgcatgaggtacagccatatgaataaatatgtactaacacatacctagacatacacaatcagccct

SEQ ID NO: 1868 - DNA, 42 bp, Homo sapiens
caccgttggttagagacatgtaacgcacctccccaattgatc

SEQ ID NO: 1869 - DNA, 286 bp, Homo sapiens
gccattagcaagatggataatccttgataaataaacttgtaaatacagtaagatgtacaaaatatcacatagtgataggatgccaagattagtttttttctttaagagttcatttggagtactaaaccccactgtttcattttaatacacttaatagtccttggtttatgaagacatttatgtgatgatgaaagttatttagcatctttatggaaggacttagctgagctgtattaggcaaaagaaggaaagaaagtggttacagggcaacgggtcagtgagatct

SEQ ID NO: 1870 - DNA, 630 bp, Homo sapiens
cggcatcagatctttgggttagtcactattgctggctttaaaagaaattccttggcttcaggtagttcctggaaatttttctaagcattatggaacaggttgtcctagacagaagtagcatggcctgaagccaacaataattacaatcaggtcttctgatctttctccctgccccccaacccccaccaccttcttaaacagctgtgaagggaagtgcttaatggtatccaaaacaaagaggatgggtaaatggcacattagtgatgtattcagatagtaggagttgaattgaattgccaatgccgaaggatagaaaaatattgaactatacgtaacctacatgtagacataatggcagtaagggcaagaaagctaaattcaccttaggaagggaaaaagagatttaatacatctggaggaaaataattagagggccagataatcaattgcagagcgccgccaggaaacatcgtgttgaaagaggccggggtgattacaaacgagtctcaatgtcatgaggcaacaaaaaggccagagcaactggaggccaacagtgctgcaccctgacacccaaggcccccatcagccttggaatgagtgtgatgggtgagcgcacatctggaatactga

SEQ ID NO: 1871 - DNA, 782 bp, Homo sapiens
cctgaggatttctagccagaggtcccagatgcctgggctgagaacccagcgataagggggcgttcccaaagcagacacagggataagaacagaggaggcagcagcattgcacagccccaggcacagtggcagttaggatggctggagagtaggatagttctatgggttgcccaaaaaatgtgatgcgcttcatgttttctctgactcatggatctggtagagaccatagacatgatatagactaacttccccatttttcacaagaggaaaccatccttatgacttaccttaaagttttttgttctgttttgaaggaaaccatgtgcttcatgaaacctacagttgacaagagaatgtacagctaagagaaaagcttaagaggccacactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggccaccgctttgtacatagca

SEQ ID NO: 1872 - DNA, 812 bp, Homo sapiens
gctacaacatagacgcatctcgaggacactgtgctcagagaaataagccagtcacagacagacaaatacttcatgatttaactgatatgaagtgcttggaatagtcaaactcacagaaacagaaagtagaatggggttgctgaggctggagggaatggaatgtttaatgttatttaatgggtacagagtttgttttgcaagatgaaaaagttctggagattggttgtacaacaatggcgacatacttaacactactgaatgtatacttaaaaatgattcagatagtcaacttctattatatgtatttcaccacaaaaatttcttaaagtagcaagaaataaataaaattgtaaaaacctgatgttagtggctatgtagggaaatggatatcatatactcacaacaggaagtgtagctttctggagtcatttgagtctgtgaagagagttataaaaccataagtgctcactgccgaggcaatgccactccaggggatacatgtgtacactaaatttacagagatgctcacagctgcacgatttaaagtagtcaaaacagtttaacagctcaagagatgggctacatatcctttagtataagcacaatggcataaaatcatgcaatcattcattcatgatcttttttgagcacgaacaagcagatgaaagttatgctttccacagaaaaatacaatttcagagcatttatagacttctagaaacccatccatgggacttcctttgggaaggttaagaatcctgagaaaaagcctcttcaaatgtgtttgtgaactctgccggtacagggaaata

SEQ ID NO: 1873 - DNA, 29 bp, Homo sapiens
caaaccagggcaaccagaccgagaggagc

SEQ ID NO: 1874 - DNA, 181 bp, Homo sapiens
gaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggt

SEQ ID NO: 1875 - DNA, 77 bp, Homo sapiens
gaccactgcccaatcacccatgtcacgggcttggcagccaggctcaggtggaagcttcctgcatccgtcctctccac

SEQ ID NO: 1876 - DNA, 30 bp, Homo sapiens
gctttgtctggcctcacgtgtctcagattt

SEQ ID NO: 1877 - DNA, 82 bp, Homo sapiens
gagatggttctggacaatatcccaaagcttctgaactgcctgagagactgcaatgttgccatccgatggctgatgcttcata

SEQ ID NO: 1878 - DNA, 201 bp, Homo sapiens
gatcagtttcgaatctgcctcctcgaccaactaaaactggggagtttatgtaccgaaaaaaggaatgtaactatgtgtgaggaaaacagcaattaggaaaaggataaggaagcagtcctgacctatgaggggaaagaggtgtctggggtctcattgtcaaatggtgatttggtgagtttcagtccgttgcctgaggaaaga

SEQ ID NO: 1879 - DNA, 33 bp, Homo sapiens
atggctgccaaactggaacgtttgcgagagaag

SEQ ID NO: 1880 - DNA, 98 bp, Homo sapiens
catgatgtgattccaatgtacccgaatctgaataaagccacctagcatgtacccctgcataagtgtctaggtaaatagatggttactgagtgtctccc

SEQ ID NO: 1881 - DNA, 30 bp, Homo sapiens
caagattatcagcaaaatcgagaatcatga

SEQ ID NO: 1882 - DNA, 98 bp, Homo sapiens
gcaggtgtaagtgtgataattcagatggaagtggacttgtgtatggtaaattttgtgagtgtgacgatagagaatgcatagacgatgaaacagaagaa

SEQ ID NO: 1883 - DNA, 91 bp, Homo sapiens
attgatgccttcagattgatcaatgctaatatgatggtcttaggacatgaaccaagacaaacaacttcgaatctgggtcacttaaacaagc

SEQ ID NO: 1884 - DNA, 96 bp, Homo sapiens
agttcttccagccattgcgactgtggcccacgcatgtgggggaagaggccatttttcacgcccatcccagttgagtctttagatgatcccttcctg

SEQ ID NO: 1885 - DNA, 124 bp, Homo sapiens
tcctgagctcacaggtttctcccacctcagcctcccaaagtgctgggattacaggcatgagccaccatgcctggcacaatttctttctagaacccaaatcatctgccagatcagaagtcatttt

SEQ ID NO: 1886 - DNA, 86 bp, Homo sapiens
tgtggcagtggccatctactgctcaaagtccagggcaacatagcacagtttctccttgacgtagtgtctgatctcccgctcggcag

SEQ ID NO: 1887 - DNA, 47 bp, Homo sapiens
tattcatttattgatctccccacaccatccaacatctctacatgatg

SEQ ID NO: 1888 - DNA, 178 bp, Homo sapiens
acagggggccgagcagaagcccccagcgtccagggccgggggagggtccgcctgcgcccccaggcccgcgtggtcgggccctgcagggcgggaggcgcggcgcggggcggggccggtgacgggacgcggagaccccgcgggcggcgggaggggcacgaggcgcgcgtttgcacccgag

SEQ ID NO: 1889 - DNA, 54 bp, Homo sapiens
ggggtcaggccttgcttgcataaaggagaaaacaactctatgtacatgctgggg

SEQ ID NO: 1890 - DNA, 80 bp, Homo sapiens
cgtttggcaacatattgactgcatggggattgataggcagcatattcctgatacatatctatgtgaacgttgtcagccta

SEQ ID NO: 1891 - DNA, 29 bp, Homo sapiens
cttctgtgtaatgtccgctcctacctgat

SEQ ID NO: 1892 - DNA, 155 bp, Homo sapiens
ttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagaga

SEQ ID NO: 1893 - DNA, 478 bp, Homo sapiens
ggaggtacttcccttcaggtcattctctccttgcttcaggcagctgctcccagaggagaaaatggcagctccctgggaggtacttagggatggtgaccaccagctgatcagcaccaagaagatgagcaagagccaggtgtccacagccctcttgtacctcccccctgactcccttgctacctgtgtgttttctccaggctgtcacactgcctcccacccaccaatgcagcacacatctgctgggaaggcccaaggcttaacaccactgcctgctggccactctgctttgtcgctctctggagaatgtcctgtcagtcactatgaaatgacttctttggagagagatgaaaaaccttttctgaaggctggggtgtcaaaggataaaaaaaaaatcaaaaggctacatcatgccttacttagaaatattttgggaccagaatccattgttttgcatgccttttgcgtagattggcctctg

SEQ ID NO: 1894 - DNA, 203 bp, Homo sapiens
ccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggc

SEQ ID NO: 1895 - DNA, 57 bp, Homo sapiens
agctggagcgccgttctctcctgctgggacaccgcttgggctttggtattgactgag

SEQ ID NO: 1896 - DNA, 61 bp, Homo sapiens
tggatgtgttccgaggcaactcagcatgtgcagttggaaatgtgccgcttttatttggcag

SEQ ID NO: 1897 - DNA, 415 bp, Homo sapiens
cagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttttgttaagcctgtattggtcttaaggtgcagtattttttaaattattatttatagaaagaatctataaattcttggggaagtgtgttataagctttaataattacattgagctgcacctcagtggtgtgtcattaacatgcagtggggttaatatctgaggcctc

SEQ ID NO: 1898 - DNA, 298 bp, Homo sapiens
gtgataaacccaggcaacattcttttcaaatggataatcaaaagagagaattgatcaaccaagatgaaagtgtcataaggaaccaataagtgataatgttggaagtgaaattcaaatcaaaacaagtagaattataaagaagaattagctgaccacgggaatgttgacactgctgccatttgagttactgtaaatctgcagccagaggaacttaacgaaggcaacttatcagcataaatgaggaaagtggttgtgacaaaaaggatgaagatgtcccagaagaagtaacgccagcaca

SEQ ID NO: 1899 - DNA, 122 bp, Homo sapiens
cgtctaagaagcaaggccactgttcctcctgtagggacaacgatcctgtctcagagacctgtccttctgctcctttagaaaacagaaccagcacagcgtccacaccgacagcagttactagg

SEQ ID NO: 1900 - DNA, 528 bp, Homo sapiens
gaccctcactgtgcctgttacctgaggggtgatttgcagcacaggcagagttatcttggctccagcactctgcgtgccagggcctcagcttcatgaggcagtgctcttctgggggttcctggggtgcagttggctgtggggcttttgggtactttttgttgcaataatgttttttcagtctgatatatttatatgtatacgtgtgtgtgtgtgtgtgtgcgtgcgtgtgtattttcactaatatagaaaaatattgtttttataaacaaaacatatatgcaaatattctttgtatgaaagaaaatatacccttcgcggtgttcctaatcacatgtttgtactataatttcacgtgggttcagttaaactagagctaaggttgtccatggcatgttgagtcagttgtcataatggtcagtgagtaaaactaacctactatgacaaacgtgacttacacctctatgtgagcaaacaccttgtgtgtgtgtgtgtgtgtgtgtgtgtgttaccagcatacaccctagtagg

SEQ ID NO: 1901 - DNA, 70 bp, Homo sapiens
aggaaacaagcttcgtcttgagatccccatcagcggagaaccacctcctaaagccatgtggagccgggga

SEQ ID NO: 1902 - DNA, 234 bp, Homo sapiens
tgaatggttatgcaaaatgtggcatatcctacaatgtgtattatttgcaataaaaaggaatgaaatacatggatgaaactgaaaacatgctaagggaaagatgccaatcacaaaagaccatacatttcatttatataagatgttcaaaatagacaaatctttagagacagaaagtaagagactgaggcaatgaaaatgttctaaaattagacagtgatcgtgagggctgcacaa

SEQ ID NO: 1903 - DNA, 135 bp, Homo sapiens
ttgccttagagggaaatgatgccttgtacatatctcatcccacagtgctgctgaatgcgtccatttcaggcaatgcccaatttggagaaaagaagaagtgcaaaaaaagatgtttctttgacctcaccgcaaata

SEQ ID NO: 1904 - DNA, 32 bp, Homo sapiens
tgcttcgattgctttcgagtcatgagttggtg

SEQ ID NO: 1905 - DNA, 312 bp, Homo sapiens
cataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctca

SEQ ID NO: 1906 - DNA, 436 bp, Homo sapiens
tacagggccagccttctagcctttaacaattcaggaaatcataaaccatcacttgttcctgccaacttcctaattcctctggtaccatgcagacaaagaaacactctcttccaatcgcaaataaaatcttttttctctttttttaggtggactcttgctcttgtcacccaggctggagtgcagtggggtgatcttggctcattgcagcctcagcctcccgggttcaagcgagttgcctgctcagcctcccaagtaacagattacaggcacctgccaccacatctgactaatttttgtattttagtagagacagggtttcaccatgttggccaggctggtctcaaactcctgacctcaggtgatccacccatctcgggctcccatagtgctgggattacaggcgtgagccaccatgccctgccagtaaagtcttttt

SEQ ID NO: 1907 - DNA, 151 bp, Homo sapiens
aaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaa

SEQ ID NO: 1908 - DNA, 33 bp, Homo sapiens
atctctggctgtgaccgcacagtaaaagagctg

SEQ ID NO: 1909 - DNA, 81 bp, Homo sapiens
tatatatgagagatcgagaaattgctgccacagccagagacctagaaatgagacagctggaactcgaatcacaaaagagac

SEQ ID NO: 1910 - DNA, 45 bp, Homo sapiens
gtgagaccctcccgacaggacaaaccactctgccgttatatgtga

SEQ ID NO: 1911 - DNA, 260 bp, Homo sapiens
tccagagtatggctgggaattactattataatcccagaaagtcagaactccttgggtgccaaagtcccctgctataatttagtaggcacaattcaaaggttgtctgcatattcaaaggccatcatctcccaaggaacgaggggaacttctatattaaacatgcaaaaacaacaaaaaatccattcattcattcagaattgcctcctcccctgccccctcccttccccctgggctttcctaaccagtttgatattgaagct

SEQ ID NO: 1912 - DNA, 79 bp, Homo sapiens
acaggtggatcaatgcagggcatgaagaagatgaactcaaaccatttgttgaaccagagctagacatctcagaccaaaa

SEQ ID NO: 1913 - DNA, 38 bp, Homo sapiens
tgattctgcccggagtaagacattgacgggagctgggg

SEQ ID NO: 1914 - DNA, 52 bp, Homo sapiens
ttggccaacagcgaaaagcaaggcatgcggacacacgccgtctctgtgtcag

SEQ ID NO: 1915 - DNA, 163 bp, Homo sapiens
caaccttagaggatagagcattatgtggaaggagggtgaggacttgatatgaaaaaagtgatgacatacccctggttcatttctgggtttcctcctaggccaattcaaaacttccaaaataaggtcaagtaacacaataggctcacacttgcatcacaagctg

SEQ ID NO: 1916 - DNA, 253 bp, Homo sapiens
gtgaaccgtttctgcccttatccagagtaaaatgggtcacaactttgtctaaaggaacacttctgcagctgtagtcaaaggtgtacacattgagtattccacagatatacatggtttaatatgtggtatccatggggtatgattctaccacagccttgtaagtgctccaaaccttaaagtacccacaattactacacctgtgactggaaccaatgatcccttttattccccgccaggacaaaccagtatgtag

SEQ ID NO: 1917 - DNA, 145 bp, Homo sapiens
aagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttc

SEQ ID NO: 1918 - DNA, 124 bp, Homo sapiens
atggcacagatcaacccagtgtccattccatggaagcattcagagactgaggctcctcagtcctaccacagaaacactgagagttacagaatggcaaatatctgtaactggttccaagcaagag

SEQ ID NO: 1919 - DNA, 45 bp, Homo sapiens
caggagcgagcctgcagaccgggcgttgcgcccttcgcctctccc

SEQ ID NO: 1920 - DNA, 246 bp, Homo sapiens
catttcaggtagagcgtgtcacatggatgtaaataccaaaggtcaaggacatgggcttgagagatggtgagaaggatggaggtgactgtggcttgcattctatccgtatcactattaattaccttctaatgcctttggctctaggtggtggaacaagtaaagtaatggacaaatactttttctaccaatatttagtgaccaaatgcagagttatggagagggccagggacctcatgaaccatactc

SEQ ID NO: 1921 - DNA, 348 bp, Homo sapiens
caaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactg

SEQ ID NO: 1922 - DNA, 100 bp, Homo sapiens
cttcacaagtgttttacttcgacgatgtgcctttgatttaatttgggacacttttttagaaggatacattattcgtgtttgcaacggtctttgaagagct

SEQ ID NO: 1923 - DNA, 44 bp, Homo sapiens
tgaggtacgcttgggcattcctgttgcctgcatggttcggcatt

SEQ ID NO: 1924 - DNA, 249 bp, Homo sapiens
ctgagtgcagagatgttctttacaatcccaatacagtacagatttcttccccaaaacgaaatgagcaaggaaaaacagaaaaagagctatatcaaatgtgctcatgaagaaccaagccaatctcacctttctttaaaaacaaaacaaaacgatccttttgaatgtgtggtgcagacgcaggactgaagccacaggcttttggggtgctgtgagcccagggctttgctcagctcacagctagcgcggcgg

SEQ ID NO: 1925 - DNA, 51 bp, Homo sapiens
ctggatgtagggcctgcctcggcgacctgccggtcacgggccctctctgac

SEQ ID NO: 1926 - DNA, 174 bp, Homo sapiens
gggccatttgttcttgaccgacttcactccaaggatctggtgtgggccaaggctagggagtgggcagaaggcgatggctggttggagagaagccaggccgtctagtgggggaggatggttggaacatagcattgaagtgggctcggctttcaagctgcatacggtggcccagtg

SEQ ID NO: 1927 - DNA, 436 bp, Homo sapiens
catagtccttgttgtcattgacagaaccccagtttgtatgtacattattcatattcctctctgttgtgtttcggggggaaaagacattttagccttttttaaaagttactgatttaatttcatgttatttggttgcatgaagttgcccttaaccactaaggattatcaagatttttgcgcagacttatacatgtctaggatccttttatcaaggcagttatgatcatcgttttcctgccttgaccccaccatcatcaaacactcagttaaatataaattaacattttttagatgaccactcaacataatgcttaagaatggaatttcctctctgtgacagaacccaggaattaattcctaaatacataacgttggtatattgaagacgaaattaaaattgtccttcagttttgaggccatgtgtaaagtttaacca

SEQ ID NO: 1928 - DNA, 97 bp, Homo sapiens
tgattgaacgaccagagccagaattccaagacctaaacgaaaaggcacgagcacttaaacaaattctcagtaagatcccagatgagatcaatgacag

SEQ ID NO: 1929 - DNA, 36 bp, Homo sapiens
acacacccgtgaggaagttgcaagccaacaaaaaag

SEQ ID NO: 1930 - DNA, 110 bp, Homo sapiens
aagaggaacttccgccctgtccctggacctcacattttcctggaaaagaaagcttctggcactggtgcacacattaggccaagaggagcctgctttccttgacttttctg

SEQ ID NO: 1931 - DNA, 331 bp, Homo sapiens
cacatattggagttcactggcaagaactctaagataactatgactaatgtgtttgagacaattatggataagataataggcaaagactttgatcagaaaagtaatctataaaaatcaaatggatattctagaactgaatacagtgtctggagttgagaacacagtaggtggatgtaatagtggatttgtgtaacaaaagacaagattagtgaactacaagacaggtcagtagaaaaaaatacatactgaagcatgtattggaggcatgtaaacacaatgaaaagcctttagaaagataattggagtcttggaatagaatggggccaaagta

SEQ ID NO: 1932 - DNA, 256 bp, Homo sapiens
ctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctc

SEQ ID NO: 1933 - DNA, 32 bp, Homo sapiens
ggcttccttggacctgtctgcgccatcttctc

SEQ ID NO: 1934 - DNA, 270 bp, Homo sapiens
ccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctgggga

SEQ ID NO: 1935 - DNA, 72 bp, Homo sapiens
gaggctcttcttccccagggctaacctagaggaattggaaaaccgtgctcccggactttgtgtttagagatg

SEQ ID NO: 1936 - DNA, 73 bp, Homo sapiens
tgcacttaagcggaagatatttcccagaaggaggatacacaaagaagctagtcccaatcgaatcagagtatag

SEQ ID NO: 1937 - DNA, 578 bp, Homo sapiens
ctacacagtagcacaggaggcattgggaaatcacaggaggctgcacagaatgattacaaagagtgtggactctgaagtcaaactgctggatttcctatcctaatcctaccactgtctagttgtgtgatcttgatcaagttctttaacttctctctgccttggttttctcatatagatagatatagtaatactttttacattatgggtttgttatgagaattaaataagttagtttatgtaaagtgcaaagagcaaggagaagcatggtcctgtcccaggaagggagaacgggcagttcctgcaggtcatgggagggtgagagagcccagttgggtatttcgaagtacgtttatgtggcacttgtgtgttatgtgccaggttctctgttagtagtgaattggacacagaccaaaaagatacagatcatgcatgccccctttatctgactggactagaatgaattcaagttatgaaaacattttattatagtaataatttagtgtaataggaaattaagggcagcctatatgtaccaaagtgagaaggggagggagtgcctaagtctgtgctctaagttc

SEQ ID NO: 1938 - DNA, 60 bp, Homo sapiens
tttgatctgtttccaatgtgtccatttggatgtcagtgctattcacgagttgtacattgc

SEQ ID NO: 1939 - DNA, 33 bp, Homo sapiens
ttccactggactcaacatccttttgcccgtatc

SEQ ID NO: 1940 - DNA, 171 bp, Homo sapiens
cagacttctgctttgatgactgagctacagggacaggagtggtccaaggttctcaaattctgtttttgtttttttccagacttctatactattgtctgccctaggctgtagggaatgctggttagtttgctgaacagacactgtgttcagcagggtttgtggtatctcaaa

SEQ ID NO: 1941 - DNA, 273 bp, Homo sapiens
aataggtacagagtcttttgcttcctcccacccctagggggaaaaactgctttgtgctttgggaagttgtctctgaaacccggggacagaggacgcaggacagactaggagggagccgggaggatgggctgcagctgtggaggagggtttcagaggagagaggtcggagagcagaggcctgagaagccagaggcaggtggagagagggtggaaagtgagcagcgggctgggctggagccgcacacgctctcctcccatgttaaatagcacctt

SEQ ID NO: 1942 - DNA, 235 bp, Homo sapiens
tccctttagctcaccattatagatgctatttttatacttatattcagaggttgcaaactggccatgggccataaagggactctgaaagcaggtaggttctgtttggcctgcacagctaaaacattttgggttgccttttggaattcatgcactctccagccttctacatgactactgcttcttactgtgttagaatcaactccctacacctacctggccctagaaagcattaagt

SEQ ID NO: 1943 - DNA, 83 bp, Homo sapiens
cgcgcagcctgcagcgggagaccctgtccccgccccagccgtcctcctggggtggaccctagtttaataaagattcaccaagt

SEQ ID NO: 1944 - DNA, 58 bp, Homo sapiens
gaaaactacatctcagacccaactatcttatggagggcttatccccataacctgatga

SEQ ID NO: 1945 - DNA, 252 bp, Homo sapiens
agtatggagtactgaaggccaagtaaagagtttttcagggagaaagtgaccaactgtgtctcctcctgctgattgacaagtcaagtaagatgaagactaggagatgaccattggatttagtaataggaaggtccttggtgaccttgcaagagcactttcaggagaatagtgaggaagaaaacctgattggtgtggtttcaagagacaacaggaggaagagcattggagactgcagtatggacagctctttgg

SEQ ID NO: 1946 - DNA, 977 bp, Homo sapiens
gctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaa

SEQ ID NO: 1947 - DNA, 449 bp, Homo sapiens
ctctcggcttttgggtgatgccacacaacttgcaggcggcatatgcccgtagatttactgatatgcacctaaaaattcagtgtaaatcaagtttactaaaccctgaaattctatagccaaatgcttctgtgatagaaataatcagccctcagtatctgctaagcgtaaattttttccctagtttgcagagagaaactggttgggtgcagtggctcacacctgtaatcccagcactttgaaggctgaggtgggaaaatcgcttgagctcaggagttcaagaccagcctgggcaatgcagcgagacattgtgtctacaaaaaaatttaaaaattagccatgcattggtgacacgtgcctggagtcccagctactcgggatcaggaagccgaggtgggaggatggcttcagccaaggaagtcaaaactggagtgagtcatgttcaggccaca

SEQ ID NO: 1948 - DNA, 901 bp, Homo sapiens
ccgtggttgaagtcagcctacactacagtgcacagttgaggagccagagacttcttaaatcatccttagaaccgtgaccatagcagtatatattttcctcttggaacaaaaaactatttttgctgtatttttaccatataaagtatttaaaaaacatgaattgagtttctgtagatttctagttctcaactttagcctgaacgccaacacttgaaggtgtttttcatcctctgtatgttgaaggtggttatttgtatgtaggaacaggactgccatcccagctttgcatgccaaagaaataaagaacacactttaaagggcaaactgaagagatgagcgagcaaaggtgcccttcaggtctactgaaaagttagagtacaaaacaacactgttgatctggacaaaagaagaaaaattaccctttttgcttgtgttgtgacaacttcatttaatatggtttaaagatttatgagactgtcagctaaaagtcttttcacaagaatgtcaacagagaatggcatctcaaaatatatatatttctttgcacaatttgtgaaaccttataagccattttccccaggtacaatgtagttcctgctgatagaaaggaaatattttgtcaagagctttcatttaaaagctactacctccacaatcacccccaaacccagaaaatccccactggctcttgccagtctggttttcgtattgcagttattccaattgtatttgatctccctgataacgtattttcatgggtttgggtagaagatgctaatcagattagaagcaggaatagttatttgctgtctgtgaaattgagccttttggtgcgccacgtggtgccagatcaacacttctatccctctgcactgaccacgttgtgaactgggagaccaaa

SEQ ID NO: 1949 - DNA, 144 bp, Homo sapiens
ctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttc

SEQ ID NO: 1950 - DNA, 229 bp, Homo sapiens
aaggttttccttgagctggtctctctctactttgagagtctcctccacactcctaaggtcatctctttcttttgttacagatctcatttcttcaaggttttcatgtagtatctgagtcaaccttatattctccgtttctatgttttccaggtttaacttctgggtctcaaattgctccttcaagtgttctatttcacacattttctcctgagtctcattgacagctgtc

SEQ ID NO: 1951 - DNA, 152 bp, Homo sapiens
cgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagttttta

SEQ ID NO: 1952 - DNA, 110 bp, Homo sapiens
gggaagcctctgttcgactgtcagatccccgaggttcagaggacggatacagcaggaacgaaaaaacatccgacccaacattattcttgtgcttaccgatgatcaagatg

SEQ ID NO: 1953 - DNA, 331 bp, Homo sapiens
agcagtctggcaggccttctcaagtaaataccaaccctgtttctgcagcagcctcagcagcagctcagtctagacagggtttccttctttctgtttatttttcttgctatcagagccctgatgtgtacattttggaatgctggagtagctgcttcatttctattcctccatctcccctccctcattgaaggggctggtggaactagaccagatgtctaacaaaccccgattgctagagtgtctggctctgtacgtgactgaccaatcataatacggtgtgccaagttttttttatacctctgacaacagcgtacaaaacctggactgtttc

SEQ ID NO: 1954 - DNA, 49 bp, Homo sapiens
tgcgcgcgcgccagtgcaagaccgagattgagggaaagcatgtctgctg

SEQ ID NO: 1955 - DNA, 31 bp, Homo sapiens
tggagatgcgggcaacgacacaagaaacaca

SEQ ID NO: 1956 - DNA, 80 bp, Homo sapiens
acctttggagatgagtatgcatccagcggcaagcgctccactctcagtctttactaaggaatctacagcctccaaacaca

SEQ ID NO: 1957 - DNA, 81 bp, Homo sapiens
gagattgcagatgtcagcgtccagatgtgcagccccagcagagcaggaatgtatcagggacagtggcggatgtgcactgct

SEQ ID NO: 1958 - DNA, 451 bp, Homo sapiens
caaagttcagtgctcggtgttctcggcacaacaatgcagtgtagttcagaaggtattttggcaactcttaatctgaacaagaatggggggggcgcttttgaaaaataaggctttaagaaggcttgtcattttagggctaaattttaatagaatgtgagtctgaactcttacatttagaacaaacaaaaccttaaaattactgattggttcaaaaaatggttttatggaaaaattaatctgtaacaaaaagttggcattgagtgcgaaggctccaccgttgttttttttttttgttttttttttttgtttttttttgagcaaagcgtacaaaggttccaagggacaggaccaagaacgaggggctgagacatttacaacagcaggcattttctcttcctcttcttcacgggaggcgggcagaggactgctcggatcgcttcgtcaaacactg

SEQ ID NO: 1959 - DNA, 29 bp, Homo sapiens
atgttgctgccacgatcagtgccacagag

SEQ ID NO: 1960 - DNA, 81 bp, Homo sapiens
gtggtccagtgccaagagacatttatcagagaattaaaaaacttgaggataaaatccttgaattggaaggcatctctcctg

SEQ ID NO: 1961 - DNA, 73 bp, Homo sapiens
tgttgtacagggcagcatgtcctgaaaggggctgcaagaaatgctgattccaagggatgtgtgccagttctct

SEQ ID NO: 1962 - DNA, 396 bp, Homo sapiens
acctgaagggcctacagatggattcatttctctataattcttagcttgcagttttgacaaccagaacctaaacccacataagagcctgccaatgaccacagattctcagaggaaccttttttttaaaactccacccacagctaacactaagattacttccttcctgaatacatatcaccagacgctctcctttgtcccattgtcgctatattgccaaatgccttctctcgatttttggtcaaagtcctaatcatttcaggtccaattaaaaactcagtatctcttgagccttccccacaccatatgttgcaaaattatctggtctttccacattcacagcgttcacaggccactgttgcattacctattagtctgtgagtgtacacgttcggaccc

SEQ ID NO: 1963 - DNA, 185 bp, Homo sapiens
atggtgtctttgtttggagcccaaagggaaggattgactagattgggaaaaatgcagattgggagatgtttggagtgggccagatggagaagaaagagtcaagtcacctccacccctagtggcctgaatgctgtcatgcggaattgcctggtccagttaacaaaccctcgcttcattgttttatt

SEQ ID NO: 1964 - DNA, 268 bp, Homo sapiens
tcagtcttgtgtgggtacaggtttatatgtgccaactaaatgaactgtaagcagcactgtgagcactgattatttaaggtgactgaggattactgtcagtgataggattgtgttataattccacttatatacatctgatatggaaaactgaaacttccattttagaagagaaagaaaatagctgaatttggcatttcagtagcatgctatagaattcatcatgattaatttcacattaaattatgggcaatagctgtatcacatttca

SEQ ID NO: 1965 - DNA, 640 bp, Homo sapiens
aatggttgttcaagccaggcctgcctcattgaaagggtgaaatcttccttcactggaaggaagtgagagaattagtcaagcagctatctgaggaaagaacattccaagtaaagaatatacagcccatacattgttggatgtgtgtacattgaaatttttgtgcagtaaaatgaatatttcatttacctatataattttacataaaataaaatatattttgaatgtgagtttgttccaaacaaatcattttcttgccttcaaaaccactgagcttaaagaactctttcaagtgtcattagagatagattccaactacaatcaacattgtggaatccagaggaggcaaaatgaaggaagcagcactcattacaaaatgctgctttgtaaagaattaattctgtcctggtatgtttcacattaggtaatatgaaggaaatgaatatgtcatgaaccctccttgaggatgtgggggaattaaaagtaatttcgcttaatatccaactctcacttttggctttgtagtcagagggaaacaatgctttcccaggttctaaggtaaacgttaaaaggttacaaggagacttggaagagtcaaggaacgcttccaccaactattcctgccattccagttgggagggtt

SEQ ID NO: 1966 - DNA, 131 bp, Homo sapiens
agcctgcttagacaaatcctgctacctgtcagccctcctgtgggtgccaaaccggctgccaggttaacctctggggaaacaggaagacctgctgatttaacccctacttcccttcctataatccacagtaa

SEQ ID NO: 1967 - DNA, 60 bp, Homo sapiens
gtgggactcttctggggacacttggggtccacaatcccaggtccatactctaggttttgg

SEQ ID NO: 1968 - DNA, 99 bp, Homo sapiens
tgtgtcgtggtatagcagaagtgcttgaagatttgtttctctgccttatctttagtaattgtgtttatgttggctatctggctattgcccttgcgtgac

SEQ ID NO: 1969 - DNA, 551 bp, Homo sapiens
gttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacata

SEQ ID NO: 1970 - DNA, 178 bp, Homo sapiens
tactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgt

SEQ ID NO: 1971 - DNA, 312 bp, Homo sapiens
actcccgctctgatacacaaacttgttgtaaaaataatgcagaaacatatacgtcaatctaagtctctgaaatatggccaactctacctcgccgtatatccaacattaaaaagaaaaaaaaaggctgtttaagaatagaactcattcccggtttccaccaaattatttccctaattcttaaatcctcaaataagttcttaatctccaaagtctcggttgtgggaaaaacattaatttgtgcagtccaacacttacatactttcttgacggaagggcaatcctgtccctttaaactcaatgaaggcagcggcc

SEQ ID NO: 1972 - DNA, 437 bp, Homo sapiens
ggaccctctgggaatccatagcttcctaatctggagatgggaggtcataagggagacgctgtggggttccttgaagtttcttgggttcacagaggagccccctcacttggtgttctcccgtgagccagcctccacctgccaaagacactctggtcctcgtatagtgagtaatggggctcagggcctctccaacaacagagaggagctgatgctgtagggctgaccccgtgacttcctgagtcctcaccctgtccagtgctttgagattcttcccacctccccatcctcaccagccggatcgggcgctgtgcagtgtggtcagcatggtgaagaaagtcatttcctcggtgggcagtattcctctttatctctcattacactggaaatgttatttctgctgtatcatccgtgctcaacgttttagtctgtcaggctca

SEQ ID NO: 1973 - DNA, 29 bp, Homo sapiens
agagactacagtaacccgacacgaagcag

SEQ ID NO: 1974 - DNA, 714 bp, Homo sapiens
ggaggaaataaagccctgttctggatcccccatcccctccagaataagagcatgttctgcatgtattaatcttttatgctgtttatgaaacaggcaagataagtctgtttttccttctggaaccataagggtaaccagattttcatctacagacaagtggtagtcatttgtgtttatcatgcaacttacttacaaacaccaagatattaattgctgcaacttgatgtcaaatcacattactgggtaatttttaagactatgtacccacaccatacatacatacatatatatatacacatacatacaaacctgtgtgccaagtgacagctatttttttatatacatggtaattcattaaaattgccttagtaatatattagaatatacaaatatgtgtgtataaaataaacatacacacacacacacacccctatgtagtttttaaaacactggcaatgacccactccccttggaaatgcatgtatgaactaccctatgaaatgtaagctgcagaatagataaaacacaggtttccactaataaaagacatctgaacgtcctgaatatagagacagaagttttttgttgttgttgttgttgttttaacatgtttaaccaacagaagttatttacagaaattcatatatccaggcaacacaaaactcctttattcaaaatcactgctatctttgggactaaacacaggctactttc

SEQ ID NO: 1975 - DNA, 130 bp, Homo sapiens
ggccaatggcattccgggtacacctgggatcccaggtcgggatggattcaaaggagaaaagggggaatgtctgagggaaagctttgaggagtcctggacacccaactacaagcagtgttcatggagttca

SEQ ID NO: 1976 - DNA, 94 bp, Homo sapiens
ttggctccactaacacactgcactaactgtggtccggggatcaggaagcagcatcgtggctgcatcatcatgcctgccacatttgcaccaacag

SEQ ID NO: 1977 - DNA, 65 bp, Homo sapiens
gtcacatatatgcctaaatgcacagtcatgtgcctacgtcctgcctcgcaatgagggagcatgta

SEQ ID NO: 1978 - DNA, 45 bp, Homo sapiens
gattcagtggatcccgttgaaccaatgccaaccatgactgatcaa

SEQ ID NO: 1979 - DNA, 181 bp, Homo sapiens
aagtcaagtatggtgagaaacatccagaacacacaggacagtcccacatgaaaaagaattattcagccaaaaaagtcacgagtgccaaggttgagaggccctggaatacagcaactacactataaaaccaacttggaatgtctcccaaatgaaactggttgacctcggtgaacttcataaa

SEQ ID NO: 1980 - DNA, 32 bp, Homo sapiens
atatgaggaaccagttccaaggtgctttctca

SEQ ID NO: 1981 - DNA, 35 bp, Homo sapiens
agaaatggcatgattcacgacgctggcagctctct

SEQ ID NO: 1982 - DNA, 669 bp, Homo sapiens
gtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaac

SEQ ID NO: 1983 - DNA, 434 bp, Homo sapiens
tcaggttcgagcagaggctactacaagaagtagggaatcaagtccctcacatgggctattaaaactaggtagtggtggagtagtgaaaaagaaatctgagcaacttcataacgtaactgcctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaattgcaggaaatggtttcttctattcaggcttcaatggacaggcaccttcgggatcaaagta

SEQ ID NO: 1984 - DNA, 112 bp, Homo sapiens
ggctatttcacaacatcagacagtacaatcagtatctgccatatggctggtctctgtagacgccctttgctgtcctcgctgaaggtgccttgtgtcttgagttagtccactc

SEQ ID NO: 1985 - DNA, 39 bp, Homo sapiens
tcatcattttgttgcaaccctcctgacccggcgtctcaa

SEQ ID NO: 1986 - DNA, 181 bp, Homo sapiens
taggaggttccactctcaagtcacctagaagtttgattacatattgttacttacaaaactataataaattggatgcacagctgtttacttcagtctggtgtcttcaaccaaaatatgtaccttataccaaaacaatgcttattccaaaatattttttgtagctagtagttctttccttgga

SEQ ID NO: 1987 - DNA, 121 bp, Homo sapiens
actggagccctcatcacctaaaagtaaaaagaaaagtcgcaaaggaaggccaagaaaaactaattttaaagggctgtcagaagataccaggtccacatcctcccatggaacagatgaaatg

SEQ ID NO: 1988 - DNA, 84 bp, Homo sapiens
atgccagaaggaaagccgaaatgctacaaaatgaagcaaaaactcttttagctcaagcaaatagcaagctgcaactgctcaaag

SEQ ID NO: 1989 - DNA, 363 bp, Homo sapiens
tctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtc

SEQ ID NO: 1990 - DNA, 203 bp, Homo sapiens
gccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttctt

SEQ ID NO: 1991 - DNA, 108 bp, Homo sapiens
gctaagtgtcctgatctgctcatgaaatccttctatgggggaagctgtggggcagattccttaagcgaccctttgggacaactcttatcagggaggagcgaactgctc

SEQ ID NO: 1992 - DNA, 70 bp, Homo sapiens
ttgatgatgcaaactactccgttggcctgttggatgaaggaacaaaccttggaaatgttattgataacta

SEQ ID NO: 1993 - DNA, 122 bp, Homo sapiens
gtggtgaatgtacctgtcacgatgttgatccgactggggactggggagatattcatggggacacctgtgaatgtgatgagagggactgtagagctgtctatgaccgatattctgatgacttc

SEQ ID NO: 1994 - DNA, 146 bp, Homo sapiens
gtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaat

SEQ ID NO: 1995 - DNA, 336 bp, Homo sapiens
cccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagacccttt

SEQ ID NO: 1996 - DNA, 48 bp, Homo sapiens
gtggaatgcatgtcaatggcgcacctcctctgatgcaagcttctatgc

SEQ ID NO: 1997 - DNA, 219 bp, Homo sapiens
tggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtg

SEQ ID NO: 1998 - DNA, 107 bp, Homo sapiens
cgcctggcattaccgcatgctggggtcattgggggaggggggtggggctcacgctgtcctgtggtcttgagatttttatttttgcatatgtaatccattctgtacag

SEQ ID NO: 1999 - DNA, 116 bp, Homo sapiens
aagccgaactagaacagcatcttgaacaagagcaggaatttcaggtcaacaaactgatgaagaaaattaaaaaactggagaatgacaccatttctaagcaacttacattagaacag

SEQ ID NO: 2000 - DNA, 770 bp, Homo sapiens
taggtgccctgaaagttattgttgctttttttgttttttttttttcagtttgtgcgtgtcacttgaatcagaaaccaaacacatgtaaaaaaatatcatcctcaatgccccccattaactctctctccagaaggtgacaatgttagtgaactcaagactctcactgatgatggtattttacaatgaaaacacaaggaaaccctttgaggtccaattttcacatcatattctccaaatagtaaaatagcagctctacatgttgatgaaaagaaatttcaatttcttcctatttgtttttactcatatcaacattaatatgtatctggatttattaatttccaaaaagaaaattttagttaccaaatatttcagaaatttaataaagcattacatatatgtaattagcacttatctaccaaaaaaacatatgtgtatgtatttatttatcttaccttcactgaagttcttttttctggctggacatgagaaacaggattaagtgatcaatgctggctttatttcttcataagcagtaatttgggtctttttcattcaacacaacgcagcattttcataataaattcacaaaagacaatacaaagaaacacctactgaatagaactctgtcgagcaattcatgttttaaagttggactctataccaaactggcattatggtattataggcatttgatttttgttttcttattttcagtttgtcagtttctttactaccattatttttttctagccggagataacgtataatca

SEQ ID NO: 2001 - DNA, 85 bp, Homo sapiens
aattaacaggcgaatgcacttctccaaaacaaaacacagcaagtttaatgaatctggtcagcttagtgcgttctacctttttgcc

SEQ ID NO: 2002 - DNA, 83 bp, Homo sapiens
tgtggaatgtcagcccggacctccaggtgaccagggtcctcctggaattccagggcagccaggatttataggcgaaattggag

SEQ ID NO: 2003 - DNA, 106 bp, Homo sapiens
ggggacttaggagccattgatgaaaaatacgacgtggctatatcatcctgttgtcatgcactggactacattgttgttgattctattgatatagcccaagaatgtg

SEQ ID NO: 2004 - DNA, 173 bp, Homo sapiens
tgccaagcatcaacgtgaagagaccctctatgcacacagtggatatgttatgcctggctgtagccaccttctcttctgaaaacaagatgggaatgacggaactgtattaaaagattaagttatccactagggagcatactagcacacttccagatcagccttgagatgctaga

SEQ ID NO: 2005 - DNA, 90 bp, Homo sapiens
gccagggctgccatataacctgacaggaacatgctactgaagtttattttaccattgactgctgccctcaatctagaacgctacacaaga

SEQ ID NO: 2006 - DNA, 321 bp, Homo sapiens
tgcacatcccactagtcaaaaggagagatgcagagtaaaagaactagaaataagacaaaagacagaaacaacatctaaggcacaggcagaaacacttaacagtgcatccaaacttctaaaaattcttgggattaaaatacaaaaccaaatggatgttcaactcctgaagcatatggggaacaatacagcaacaaaaaaaaaaaaaaacctcaactctgaaaagccatggaaagctggaaagagagtcagaaactcctatgaagagacaacaggactttacagggggcctaccttagggtatgccagtgagatcccaaatta

SEQ ID NO: 2007 - DNA, 163 bp, Homo sapiens
atcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttga

SEQ ID NO: 2008 - DNA, 84 bp, Homo sapiens
ggcatctatgtacttcaggacaacaaatttcgcctgcttactcagatgtctgcaggaaaacagtatttagaacatgcatctaag

SEQ ID NO: 2009 - DNA, 70 bp, Homo sapiens
tgtttgtgactgattactggctgtgtcttgggtgggcagaaactcgaacttgctatgtaatttgtgtcta

SEQ ID NO: 2010 - DNA, 102 bp, Homo sapiens
cacacggtagaacgaggcattttgaatcagctacacgtacaactaatggagctcagaagctgtcaaggatataagcagtgcaacccaagacctaagaatctt

SEQ ID NO: 2011 - DNA, 91 bp, Homo sapiens
cgctttaattgattgtctgataaacccacttcaagaacagatggaagaatggaagaaagtggccaaccagctggataaagaccacgcaaaa

SEQ ID NO: 2012 - DNA, 184 bp, Homo sapiens
caagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaag

SEQ ID NO: 2013 - DNA, 143 bp, Homo sapiens
cccaaccgagaacatgaacttgctggccattcagcaccaggccacagggagtgcaggaccagcccatcctacaaacaacttttcttccacggaaaacctcactcaagaagacccacaaatggtctaccagtcagcacgccaag

SEQ ID NO: 2014 - DNA, 463 bp, Homo sapiens
tctctctggggtacaatggagtagaaaacttagggacagaaggaatatacgaatggagaaattcgatttgcccaatctttattgctcacctattaaagtgctaaacaagctgatggtgattcctgttctcagaagcctgtgttctagcaggttataagaagatgagtctggttaaagagaagagcagggaagtggcttagattatggcataaactgaagttgaaactcagaatgaaaagtaggagtttgctgaggggaaagcaatatataaagtgatttgtgctataggacataagacagattatagataagagaactcagaaatagtaaggacagtggtaaaaagttaaaggatcctccctttccccagttaaccaggagaccaaataagggacttggtggtaggagtggtaggagcaggatcaatcacttatttattaagcacctgcacatgattcaaaga

SEQ ID NO: 2015 - DNA, 39 bp, Homo sapiens
ccaaagaccggcgtgcgatgagagtgatgtctattgaac

SEQ ID NO: 2016 - DNA, 204 bp, Homo sapiens
ctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaa

SEQ ID NO: 2017 - DNA, 53 bp, Homo sapiens
tttaaacccaatgaaggagttatcataataggagccacaaacttcccagaggc

SEQ ID NO: 2018 - DNA, 82 bp, Homo sapiens
tattatgtctatggcttcatgatgctggtgctggttatcctgtgcattgtgactgtctgtgtgactattgtgtgcacatatt

SEQ ID NO: 2019 - DNA, 158 bp, Homo sapiens
tcggtgttcctattatgttagcttatgtctatggcgtagttccaatttctctttgtcgaagcggaggttgtggagtctcagcaggcaatggaaaaggagttaggattgaatttgatgatgaaaatgatataaatgttggtggaactaacacagctgta

SEQ ID NO: 2020 - DNA, 116 bp, Homo sapiens
gcccgaatcatgacagtcagcaacatgatacctggatccagccattcctgaagcccaccctgcacctcattccaactcctaccgcgatacagacccacagagtgccatccctgaga

SEQ ID NO: 2021 - DNA, 101 bp, Homo sapiens
ttggcaatcacggacacttttttcccctccaccgaatgtcaggattgaaagctgcctccgagtggttggggatggttttctgaccctacggtaactagatc

SEQ ID NO: 2022 - DNA, 99 bp, Homo sapiens
cacaggaacggggaaaaagtgcagcttgccggccgaggaggattctgtgttagaaaaactaggggaaaggaaaccatgcaacagtcaaccttctgagct

SEQ ID NO: 2023 - DNA, 790 bp, Homo sapiens
cctgtgactgggaattgcagtaataaaaaattgttggtagtagtcatattgcaacaggccgtttaaaatgatgctaatcctgggctggctgtatcacttgattctttctgtcactcggtttctaatttttaatggcaatgataaatgcaatttttgaccttcttatgtgctagactattttcttccatctcaaacaccactgcttttttgagcatatttagttgatgtatgctggtaatacttggaaactaaagagacatctctttcatgtctctcagtacatattgtgaaactgatctgatggataattagaatttgcccgtatctgtaagaaggcctgttttgggccatttcaaacaattaagattattagttctaatatgaatgtaagaaaacattggatggagaaaagaaaaaaagtttctgtgtttagagattgaaaaccttgctttgatatcttaacctggatatctcaaatagtatttcctattgttttattttttattctacttattcttaatcagaggtaacaatgtttgattactaatcatattattttaaaatgctaaacctttgatactctcttctgtaatgaaaatagctttaatttttgctgattataatacatgcctgttttaagaaatttaaaaagagaaatgtgaagaacctgaaatttgcctaaaatctcaccatctaccacacttaaaactttgatatgcatccttttgtacatttctccatgtagtactttttgaatatatatatatctttcctggtagactgtcttaca

SEQ ID NO: 2024 - DNA, 231 bp, Homo sapiens
tggttaagggcaacttcatgcaaccaaataacatgaaattaaatcagtaacttttaaaaaaggctaaaatgtcttttccccccgaaacacaacagagaggaatatgaataatgtacatacaaactggggttctgtcaatgacaacaaggactatgtgttggttcatatcaaatccaagaatattagacaaccaaacatataaccttcttgtggtttctcttaatatgcagc

SEQ ID NO: 2025 - DNA, 58 bp, Homo sapiens
ctgaatctaaactttataatggctcagagaaggacagttcaacttcaagcaaactcac

SEQ ID NO: 2026 - DNA, 90 bp, Homo sapiens
ccctcaattctagctgcaagttttgagcactagacagcagaaataaattcctaaaatgttgagttgagcaaatagttcaatgctatccct

SEQ ID NO: 2027 - DNA, 40 bp, Homo sapiens
ctgtacttttacactcctttgtcttggaactgtcttattt

SEQ ID NO: 2028 - DNA, 150 bp, Homo sapiens
agcctcatggaccagatcagtgtcaaactgtacccttgagtgtccccaaaggttccagcagagggaagaagaggactggacatgtttgggcccctgttcccggtctttggtaaacagacgcttaagttgacaacttggacttggccaata

SEQ ID NO: 2029 - DNA, 102 bp, Homo sapiens
acaaccaactgatcgttaactaagcacacaaaaatataaactggggaaacaacatcctacttaataaatggtgctgggaaaagtagatagcccacatgtaga

SEQ ID NO: 2030 - DNA, 817 bp, Homo sapiens
aaggaggcatcatcaggctgtgttcctggaaccccaataaccctgggcccccagggccagcctgttgtagagggaggctatctgaccgccggtctggcagaggagatgggtgggcagctcccagacaccccaaaggacccggttctcttcccagagcgtcctaaggttactcttggaacctgatctttgttccctcatcccagggaaatgacacactctgtatttctgttttatttagaaatgatttaaaaaacattatacaaaggctgatcagtttaaaatgtgactgacactgaaatgctgtgatgtcccccaggctgaggggaagctaggctctggggcccccagtgctttgcccctctgtctgccctgtcctggggtgatggacaaacagatgaccacaggcaggagaatctgagattggaagcctctaggctgagccctctgggcctggccccacatccctcacctctgcagcctgggctgcctgcctccatctcctgttcattctcagctggcctgccaggagccaatggggagcctggcgggaggcgggggtgcctagagctttcaagaagtgagagcaccaacctgaggagtggacagggaccaggaagtgggggaagggaggccaggaagaggtggatacaggagacacttctcatctcatctcagaccctagaggggtccacagatggggacacaagacccagccagcccactggatggcccgggcaagtaacaacctctctgtgcttcatctgagggcacggtgagagttaccgtcggcctcccagggcctaacacgagtttcatg

SEQ ID NO: 2031 - DNA, 524 bp, Homo sapiens
accagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtg

SEQ ID NO: 2032 - DNA, 142 bp, Homo sapiens
ccgatctgccatatcctgtgtaatgacaagtgagttgcattctcaccgtcactcctggggtctctccgcttcccctgagctggctcagcagtctgctccatgtgttttgatgcagggtgacccattggtattcccgacacta

SEQ ID NO: 2033 - DNA, 94 bp, Homo sapiens
cggacatcatttccaccgttgagtttaattactctggagatcttcttgcaacaggagacaagggcggcagagttgttatttttcagcgtgaaca

SEQ ID NO: 2034 - DNA, 1032 bp, Homo sapiens
ctgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgc

SEQ ID NO: 2035 - DNA, 120 bp, Homo sapiens
ctgtctgctcccctattggcgggtggtgctggctctgtccctggcaaggccaggcatggagctgagctcagactgtcaccggactcacccgggacagcaacatcccagtcgagggcccag

SEQ ID NO: 2036 - DNA, 1129 bp, Homo sapiens
cggggcctgtggatattcgtcacttcttcacgggattgactattcctgatggaggagtgcatataattggaggggaaattggggaggcttttattatttttgcaacagatgaagatgcaagacgtgccataagtcgttcaggagggtttatcaaggattcatctgtagagctctttcttagtagcaaggcagaaatgcagaagactatagaaatgaaaagaactgatcgtgtaggaagagggcgtccaggatctgggacatcaggggttgacagcctgtctaattttattgagtctgttaaggaagaagcaagtaattctggatatggctcttcaattaatcaagatgctgggtttcatactaatggtacaggacatggtaatttaaggccaagaaagacaaggccattgaaggccgagaatccttacttgtttctacgaggtttgccttacctagtaaatgaagatgatgtacgtgtctttttctctggtttgtgcgtggatggagtaattttcttaaaacatcatgatggccgaaataatggtgatgccatagtaaaatttgcttcatgtgttgatgcttcaggaggtcttaaatgtcatagaagttttatgggttcaagatttatagaagtaatgcaaggatcagaacaacagtggattgagtttggtggtaatgcagttaaggagggtgacgttcttaggagatctgaagaacattctccaccaagaggaattaatgatagacattttcgaaaacggtctcattcaaaatctcccagaagaacacgttctcgttcccctcttggattttatgttcacttaaaaaatctgtccctcagtattgacgaaagagatttaagaaatttctttagaggtactgatctgactgatgaacagattaggtttttatataaagatgaaaatagaacaagatatgcctttgtgatgttcaagactctgaaagactataataccgctctgagtttacataagactgttttacaatatcgtccagttcatattgatccaatttctagaaaacaaatgctgaagttcattgcacgttatgaaaagaagagatcagggtcactagagagagataggcccggacatgtttcacaaaaata

SEQ ID NO: 2037 - DNA, 571 bp, Homo sapiens
ccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaa

SEQ ID NO: 2038 - DNA, 74 bp, Homo sapiens
gtaatcagaaaggtgataaggtttactgatttactgcagaactggaatctccaatgggaattagtgccctctgg

SEQ ID NO: 2039 - DNA, 520 bp, Homo sapiens
gccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatg

SEQ ID NO: 2040 - DNA, 62 bp, Homo sapiens
aagaagcttatccaacgccaaccaaagatttgcatcagccatctcttagtccagcaagtcct

SEQ ID NO: 2041 - DNA, 436 bp, Homo sapiens
ttctcaggagttagtggtaaacccatgaacatgtatttttaaaccaaattacccacctcttggagttcaatctctgttaattctttattaaagtagtgaagtatcagttgttccaatgatataatgatcaagcaaccctggaaattaaatcccaaagcagtgcacctttagtttgttcagtgatagtaggacatcccacgagccatcatatattttcaagtttttatactcaatctactttttcagcaatcttttgggaactatcccaagataatttactgcataagtgcatctatcttctaaaagacatttggaatatttcttagtctgacctctgcaccctgagacactctataaaggaaacaatcagaaaaatttaacaaagaaataaataggttaagaagaaagcaatctaggcgtttgcactgagtttgca

SEQ ID NO: 2042 - DNA, 73 bp, Homo sapiens
agaagagtctctggtggaacagtttgtgtttgaagccttggtgatatacatggagagtctggccttagcacat

SEQ ID NO: 2043 - DNA, 544 bp, Homo sapiens
tctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagt

SEQ ID NO: 2044 - DNA, 97 bp, Homo sapiens
cgctaggtttcccttccatagattgtgcctttcagaaatgctgaggtaggtttcccatttcttacctgtgatgtgttttacccagcacctccggaca

SEQ ID NO: 2045 - DNA, 123 bp, Homo sapiens
gcagaaatgagcagttcgctcctccctgataagagttgtcccaaagggtcgcttaaggaatctgccccacagcttcccccatagaaggatttcatgagcagatcaggacacttagcaaatgta

SEQ ID NO: 2046 - DNA, 282 bp, Homo sapiens
tgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatgga

SEQ ID NO: 2047 - DNA, 320 bp, Homo sapiens
gtgcaagccttcaagaagcagcatattatgataaacccctcctacagaaaggtatcatttttatcactgataccacaggataaattatatattacgccatcttcaagtaacagctgaggcaacagaataaatgcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtccacgtacata

SEQ ID NO: 2048 - DNA, 389 bp, Homo sapiens
tcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaa

SEQ ID NO: 2049 - DNA, 933 bp, Homo sapiens
ttttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgccttta

SEQ ID NO: 2050 - DNA, 1030 bp, Homo sapiens
aggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcact

SEQ ID NO: 2051 - DNA, 129 bp, Homo sapiens
tgtcgatgtgtcttggcttactttacacaaaacaaactggcccaatttcaacgccgaattcctggtctgtgccgccaacatccacaggagcaagatctatgatgggcaagcgtgccacattctgtgttc

SEQ ID NO: 2052 - DNA, 473 bp, Homo sapiens
tcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctatagccattaaagcaaactttactgttctaacaaatttgtattttattttgcattgccacacatctgcttatttaaaaactacatccctttggtagtaatgtttcaggacaagtaggtattacagc

SEQ ID NO: 2053 - DNA, 262 bp, Homo sapiens
caggcacctctgacaccaagttgtgtggacagcttaaaaccctactccatggcattgggcttctaatgggacagcactcagtttttatttacaatggaaaatgttataattctggtccttttttaagtttgaacagaagggttgatcaaaatgtgttttgtctgttttaggcttgatgattcacgcttctctttaaactgccttaaagtaataaatactatggcattctgtttaatacacgaaaggtttccacttgatatac

SEQ ID NO: 2054 - DNA, 265 bp, Homo sapiens
ccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgg

SEQ ID NO: 2055 - DNA, 110 bp, Homo sapiens
gattcgcaaattgacatagccacagtacaggatatgcttagcagccaccattacaagtcattcaaagtcagcatgatccacagactgcgattcacaaccgacgtacagct

SEQ ID NO: 2056 - DNA, 250 bp, Homo sapiens
ggaatccatcatccagagtgcttacatggtgattaggttaatattgccttcttacaaaatttctattttaaaaaaaattataaccttgattgcttattacaaaaaaattcagtacaaaagttcaatatattgaaaaatgcttttcccctccctcacagcaccgttttatatatagcagagaataatgaagagattgctagtctagatggggcaatcttcaaattacaccaagacgcacagtggtttattt

SEQ ID NO: 2057 - DNA, 2168 bp, Homo sapiens
tgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttcta

SEQ ID NO: 2058 - DNA, 783 bp, Homo sapiens
ggtgaatctctatgtgctcccagtgtcctggatgggctccccagcaagccattcctccttcctgttctgatattactattcttttttacattgtgctaaggaggacaaaagatgagagatgaaaataaagctttgcctttaaagagcttatcctcagaaataagcttcgtcttgagttgttgaactacaaaacactattttctgcagtcatccgaagaattgtgccattacttgtgatgcctctgaatgtggaggctgactctccctgtctctctgtccctcctaccccacggggccgcagcaaaagccatcctgggccttcgactgggccatgtcttcaggaagattcctgaagaggagggcccgaaatacctgcctttataggttcccagagtgccctagaacattcttagatacatattttttaaacaagtaggactccaccttattttctccaatagtccccaagcagtacaggtcacttgaagacataaacattcttcttggttgagggatccacgcccttgtttcagaaatgacaccacagaaggctgtgagctccaggagcatgcgttgggatgtccggatgaccggggtttaaaggttttcctattctcgataaagcctgtgcgcactgtacggggagtgggggtgaagcgtgttctctacataggcaacacagccgcctaagtcacaaagtcagtggtcggccgcttcgaccaacatgtggtgagcattccacgggcgcatgaagtctgggtgctgtgctcgagtctctgaata

SEQ ID NO: 2059 - DNA, 130 bp, Homo sapiens
cttatttcctgggtccatgggaagcatgagtctgttgggacttgggacaagaagaaaacaagacatcttcacaaggaaaaccaagtactaaaaaaagtatcctcccaactctgaagagatagaacacaaa

SEQ ID NO: 2060 - DNA, 302 bp, Homo sapiens
tgtttagggttacattgtccacagaaagcatcaaataccactcctctccccgccaaaaccaaataaacaaagccaactctttggcaacagttgtgttaaataaaatcccaggtcacacttgtttctggctcccaagcctgggtcactgctacatggattgcgccaaaaaattcccagcttcaacactgctagattaaaattgctggcatttttaaatcacagcaaagcttttcacaatgccctcaagtccaagaggacaaaggagaaagcaacatgaacggcagatcctcatgtgaaaggga

SEQ ID NO: 2061 - DNA, 180 bp, Homo sapiens
ggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaagga

SEQ ID NO: 2062 - DNA, 86 bp, Homo sapiens
ggcacttatgcatgtttccccagtttccatattacagaataccttgatagcatccaatttgcatccttggttagggtcaacccagt

SEQ ID NO: 2063 - DNA, 397 bp, Homo sapiens
ctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgc

SEQ ID NO: 2064 - DNA, 131 bp, Homo sapiens
tctaagcggtaatggaggaagactagtgctttgtgcattttgatatatttgagttcattttttccacaatgtcatacttttgacgcagttgggtttctcataagtatcctagttcatgtacatccgaatgc

SEQ ID NO: 2065 - DNA, 72 bp, Homo sapiens
ttgaagacatgcgaatgacactagaagaacaggaacaaactcaggtagaacaggatcaagtgcttgaggcta

SEQ ID NO: 2066 - DNA, 162 bp, Homo sapiens
cttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccc

SEQ ID NO: 2067 - DNA, 176 bp, Homo sapiens
gtcccatcaatgacatgctaccagacatatcagattccacaggataatggcaccaagctacccaagtagatgtttctggtattctagactgccgttcatgcttgtttcctaaagtatacttaaaagtttcaaatacagtttcacttagaaactgcaaccctccaagtaatgttatg

SEQ ID NO: 2068 - DNA, 393 bp, Homo sapiens
gctacaatgggcaccactgttcacagcaatattaaagaggagaaaacaacacttatttaatagggacagatataccacaaggtacaacatcagtgcaataaattcacaaaactatattacagctagttaatcagtttaagaattgttcccgtcagtcacattttttggccctcagaagttcattcctaaagatttcaactactctaaatttctagctaccaagaagttaagaatgattataagaagctttccaaggagttatgaaatctttgtagaccagaggccaactatcatcacctcaagtctgctctcaccaacagcccttgtatttttcagggagaaatctctaggaaaaaagtcagacaccagtgtagtcactatctcccatgtcaa

SEQ ID NO: 2069 - DNA, 31 bp, Homo sapiens
gcagcctgcacatgacgatatggatgaggat

SEQ ID NO: 2070 - DNA, 116 bp, Homo sapiens
ggcgttgctgaatactgtccactaactgtacaaaatattgactgcatgcctcgcaaacaccaaaatatccgctggaatgccatagaaataaataacttctgctataaacacatgaa

SEQ ID NO: 2071 - DNA, 237 bp, Homo sapiens
catgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatca

SEQ ID NO: 2072 - DNA, 210 bp, Homo sapiens
ctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatc

SEQ ID NO: 2073 - DNA, 221 bp, Homo sapiens
gccagcaccgacagcaacgaaaatgttcccacggagatcaggatgacttgctgaagctcagtggaggctaaaaagaggacacgaaagtgaacagaatgatcttcctacgcacaacacaaacatcagttaatgttccatccatgctgcttaaagagcattcctgtcctagtaaaatgggcaagtccctctaccccccaccctcacctggtatgcttacatta

SEQ ID NO: 2074 - DNA, 113 bp, Homo sapiens
cggactttcctaattggagtttgaggcccctaagctggcatcaaccccaggccacgctcgctctttccttccctcccctccccctctgccttttgtacgccagttctcagaaa

SEQ ID NO: 2075 - DNA, 59 bp, Homo sapiens
cttcagaagaaggacttcggaatgcactacaacaggaaaatcatattatagatggagta

SEQ ID NO: 2076 - DNA, 69 bp, Homo sapiens
acatatctgaagagatggattaagaatgctttggattaaggattgtggagcacatttcaatcattttag

SEQ ID NO: 2077 - DNA, 110 bp, Homo sapiens
gctgcttcacatccaccccggctccccctgccagcaacgctcactctacccccaacaccaccccttgcccaaccaatgcacacagtagggcttggtgaatgctgctgagt

SEQ ID NO: 2078 - DNA, 507 bp, Homo sapiens
aggtcccttactggtcctgcttccatgagtagccgtgaccaggggaaaagggagaggaaccagccggcacagggaggggtcatctccacaacattccatttatacacagaactaaacagacaagcacagagtcactattgcggttagaagttggcagcatgggaagggggaggaccaggtggggaatggggatgttgttaaaaaaaatacaggctcccccacaactggggtgcctggggggaacttggtctgcttcagcccaagaggaatcaaaagatcaaaagcagtttgggaaggccagaaccgtcaagggatggagggagaaggaaaatccagggggtggggggtctgtttggcaactggggtgaagggattgccctccccctgctgggatccccccagcccctccggtctggcaggaagggggcagcctgcaacccccaagggcaggtgtggggctgccagatgctccaggcagggggccagaaggggctcacaaaggcttgc

SEQ ID NO: 2079 - DNA, 99 bp, Homo sapiens
atggagcattgcaccacccgctttttcgagacctgtgacctggacaatgacaagtacatcgccctggatgagtgggccggctgcttcggcatcaagcag

SEQ ID NO: 2080 - DNA, 83 bp, Homo sapiens
acatcctcttccatgaacagctttgtgacagagctcctgagtgtgtgcagcccccactgtgctctgaatacagtctctgcagc

SEQ ID NO: 2081 - DNA, 65 bp, Homo sapiens
ttttctgggaagagccccgtcaccacactgcttgagtgtatgcacaaattggggaactcctgcga

SEQ ID NO: 2082 - DNA, 393 bp, Homo sapiens
tttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattc

SEQ ID NO: 2083 - DNA, 115 bp, Homo sapiens
gccaggcaatgcttaggcaactaaaatgaggttgggggtaatgctaacgtcaccctcacagggatggccacggggactgttattcgcaagctggttttctagacctgttagctgg

What is claimed is:

1. A method comprising:
(a) obtaining or having obtained an expression level of a plurality of targets in a sample obtained from a subject with prostate cancer, wherein the plurality of targets comprises ten or more target nucleic acid sequences selected from NFIB, NUSAP1, ZWILCH, ANO7, PCAT-32, UBE2C, CAMK2N1, MYBPC1, PBX1, THBS2, EPPK1, IQGAP3, LASP1, PCDH7, RABGAP1, GLYATL1P4, S1PR4, TNFRSF19 and TSBP, and wherein the plurality of targets comprises at least one target nucleic acid sequence selected from NFIB, ZWILCH, PCAT-32, EPPK1, IQGAP3, LASP1, PCDH7, RABGAP1, GLYATL1P4, S1PR4, TNFRSF19 and TSBP;
(b) prognosing the subject as later developing metastatic cancer based on at least the expression level of each of the plurality of targets in the sample obtained in step (a), and
(c) administering a cancer treatment to the subject prognosed as later developing metastatic cancer in step (b), wherein the cancer treatment is a chemotherapeutic agent or radiation treatment.

2. The method of claim 1, wherein the plurality of targets comprises a coding target.

3. The method of claim 2, wherein the coding target is an exonic sequence.

4. The method of claim 1, wherein the plurality of targets comprises a non-coding target.

5. The method of claim 4, wherein the non-coding target comprises an intronic sequence or partially overlaps an intronic sequence.

6. The method of claim 4, wherein the non-coding target comprises a sequence within the UTR or partially overlaps with a UTR sequence.

7. The method of claim 1, wherein the nucleic acid sequence is a DNA sequence.

8. The method of claim 1, wherein the nucleic acid sequence is an RNA sequence.

9. The method of claim 1, wherein the plurality of targets comprises NFIB, NUSAP1, ZWILCH, ANO7, PCAT-32, UBE2C, CAMK2N1, MYBPC1, PBX1, THBS2, EPPK1, IQGAP3, LASP1, PCDH7, RABGAP1, GLYATL1P4, S1PR4, TNFRSF19 and TSBP.

10. The method of claim 1, wherein the plurality of targets comprises SEQ ID NOs: 1-22.

11. The method of claim 1, wherein the plurality of targets comprises SEQ ID NOs: 1-43.

12. The method of claim 1, further comprising sequencing the plurality of targets.

13. The method of claim 1, further comprising hybridizing the plurality of targets to a solid support.

14. The method of claim 13, wherein the solid support is a bead or array.

* * * * *